US011746159B2

(12) United States Patent
Bamdad et al.

(10) Patent No.: US 11,746,159 B2
(45) Date of Patent: *Sep. 5, 2023

(54) **HUMANIZED ANTI-MUC1* ANTIBODIES**

(71) Applicant: Minerva Biotechnologies Corporation, Waltham, MA (US)

(72) Inventors: Cynthia Bamdad, Waltham, MA (US); Benoit Smagghe, Waltham, MA (US)

(73) Assignee: MINERVA BIOTECHNOLOGIES CORPORATION, Waltham, MA (US)

( * ) Notice: Subject to any disclaimer, the term of this patent is extended or adjusted under 35 U.S.C. 154(b) by 29 days.

This patent is subject to a terminal disclaimer.

(21) Appl. No.: 15/549,942

(22) PCT Filed: Feb. 10, 2016

(86) PCT No.: PCT/US2016/017422
§ 371 (c)(1),
(2) Date: Aug. 9, 2017

(87) PCT Pub. No.: WO2016/130726
PCT Pub. Date: Aug. 18, 2016

(65) Prior Publication Data
US 2018/0112007 A1    Apr. 26, 2018

Related U.S. Application Data

(60) Provisional application No. 62/114,526, filed on Feb. 10, 2015.

(51) Int. Cl.
*C07K 16/30* (2006.01)
*A61K 39/00* (2006.01)

(52) U.S. Cl.
CPC .... *C07K 16/3092* (2013.01); *A61K 39/00117* (2018.08); *A61K 2039/5156* (2013.01); *A61K 2039/5158* (2013.01); *C07K 2317/24* (2013.01); *C07K 2317/34* (2013.01); *C07K 2317/52* (2013.01); *C07K 2317/622* (2013.01); *C07K 2319/02* (2013.01); *C07K 2319/30* (2013.01)

(58) Field of Classification Search
None
See application file for complete search history.

(56) References Cited

U.S. PATENT DOCUMENTS

| 3,854,480 A | 12/1974 | Zaffaroni |
| 4,452,775 A | 6/1984 | Kent |
| 4,675,189 A | 6/1987 | Kent et al. |
| 5,075,109 A | 12/1991 | Tice et al. |
| 5,108,933 A | 4/1992 | Liberti et al. |
| 5,133,974 A | 7/1992 | Paradissis et al. |
| 5,342,947 A | 8/1994 | Lackey et al. |
| 5,407,686 A | 4/1995 | Patel et al. |
| 5,736,152 A | 4/1998 | Dunn |
| 5,767,135 A | 6/1998 | Fernandez-Pol |
| 6,127,393 A | 10/2000 | Fernandez-Pol |
| 6,548,643 B1 | 4/2003 | McKenzie et al. |
| 7,538,088 B2 | 5/2009 | Anderson et al. |
| 7,825,092 B2 | 11/2010 | Vesely |
| 9,932,407 B2 | 4/2018 | Bamdad |
| 10,421,819 B2 | 9/2019 | Bamdad et al. |
| 2002/0018750 A1 | 2/2002 | Hansen et al. |
| 2002/0042089 A1 | 4/2002 | Bodmer et al. |
| 2002/0052311 A1 | 5/2002 | Solomon et al. |
| 2002/0064528 A1 | 5/2002 | Zhu et al. |
| 2002/0136725 A1 | 9/2002 | Blackburn et al. |
| 2002/0156112 A1 | 10/2002 | Bamdad et al. |
| 2003/0036199 A1 | 2/2003 | Bamdad et al. |
| 2003/0119018 A1 | 6/2003 | Omura et al. |
| 2003/0119834 A1 | 6/2003 | Bamdad |
| 2003/0130293 A1 | 7/2003 | Bamdad |
| 2003/0170237 A1 | 9/2003 | Ni et al. |
| 2003/0235868 A1 | 12/2003 | Hogenboom et al. |
| 2004/0057952 A1 | 3/2004 | Payne et al. |
| 2004/0120955 A1 | 6/2004 | Anderson |
| 2004/0131612 A1 | 7/2004 | Watkins et al. |
| 2005/0019324 A1 | 1/2005 | Wreschner et al. |
| 2005/0287145 A1 | 12/2005 | Stewart et al. |
| 2006/0122377 A1 | 6/2006 | Dennis |
| 2006/0147451 A1 | 7/2006 | Kirchhofer et al. |
| 2006/0173171 A1 | 8/2006 | Bamdad |
| 2006/0222637 A1 | 10/2006 | Bamdad |
| 2007/0212350 A1 | 9/2007 | Govindan et al. |
| 2009/0299039 A1 | 12/2009 | Kataoka et al. |
| 2010/0150918 A1 | 6/2010 | Kufer et al. |
| 2010/0316688 A1 | 12/2010 | Bamdad |
| 2011/0165167 A1 | 7/2011 | Pullen |

(Continued)

FOREIGN PATENT DOCUMENTS

| CA | 2947646 A1 | 11/2015 |
| CN | 102239182 A | 11/2011 |

(Continued)

OTHER PUBLICATIONS

Maher and Wilkie (Cancer Res. Jun. 1, 2009 69 (11): 4559-4562) (Year: 2009).*
Xiong, Cheng-Yi et al., "Development of tumor targeting anti-MUC-1 multimer: effects of di-scFv unpaired cysteine location on PEGylation and tumor binding," Protein Engineering, Design & Selection, vol. 19, No. 8, pp. 359-367, Jun. 7, 2006.
Brand, Francois-Xavier et al., "Prospect for Anti-HER2 Receptor Therapy in Breast Cancer," Anticancer Research, vol. 26, pp. 463-470, 2006.

(Continued)

*Primary Examiner* — Peter J Reddig
(74) *Attorney, Agent, or Firm* — Wilson Sonsini Goodrich & Rosati

(57) ABSTRACT

The present application discloses humanized antibodies and antibody like proteins and fragments thereof.

13 Claims, 62 Drawing Sheets
(57 of 62 Drawing Sheet(s) Filed in Color)
Specification includes a Sequence Listing.

(56) References Cited

U.S. PATENT DOCUMENTS

| | | | |
|---|---|---|---|
| 2011/0318757 | A1 | 12/2011 | Behrens et al. |
| 2012/0040375 | A1 | 2/2012 | Nishimura et al. |
| 2013/0177555 | A1 | 7/2013 | Wilkinson et al. |
| 2013/0266551 | A1 | 10/2013 | Campana et al. |
| 2016/0340442 | A1* | 11/2016 | Kufe .................. C07K 16/3092 |
| 2017/0051037 | A1* | 2/2017 | Galetto ............ C07K 14/70535 |
| 2017/0204191 | A1 | 7/2017 | Bamdad et al. |
| 2018/0044424 | A1 | 2/2018 | June et al. |
| 2019/0290692 | A1* | 9/2019 | Bamdad ............... C12N 5/0638 |
| 2020/0239594 | A1 | 7/2020 | Bamdad et al. |
| 2020/0390870 | A1* | 12/2020 | Bamdad ............. C07K 14/5418 |

FOREIGN PATENT DOCUMENTS

| | | | |
|---|---|---|---|
| CN | 102264754 A | 11/2011 | |
| CN | 102574926 A | 7/2012 | |
| CN | 103483453 A | 1/2014 | |
| CN | 103880956 A | 6/2014 | |
| EP | 0 369 816 A2 | 5/1990 | |
| EP | 2 329 822 A1 | 5/2002 | |
| WO | 1991/009134 A1 | 6/1991 | |
| WO | 1992/007000 A1 | 4/1992 | |
| WO | 1995/024929 A2 | 9/1995 | |
| WO | 1996/003502 A2 | 2/1996 | |
| WO | 1997/035024 A1 | 9/1997 | |
| WO | 1998/035554 A2 | 8/1998 | |
| WO | 2000/029029 A1 | 5/2000 | |
| WO | 2000/034783 A1 | 6/2000 | |
| WO | 2000/043783 A2 | 7/2000 | |
| WO | 2000/043791 A2 | 7/2000 | |
| WO | 2001/034145 A1 | 5/2001 | |
| WO | 2002/022685 A2 | 3/2002 | |
| WO | 2002/056022 A2 | 7/2002 | |
| WO | 2002/078598 A2 | 10/2002 | |
| WO | 2003/020279 A2 | 3/2003 | |
| WO | 2003/020280 A2 | 3/2003 | |
| WO | 2003/054154 A2 | 7/2003 | |
| WO | 2003/089451 A2 | 10/2003 | |
| WO | 2004/005470 A2 | 1/2004 | |
| WO | 2005/019269 A2 | 3/2005 | |
| WO | 2008/070171 A2 | 6/2008 | |
| WO | 2008/073817 A2 | 6/2008 | |
| WO | 2008/101231 A2 | 8/2008 | |
| WO | 2010/042562 A2 | 4/2010 | |
| WO | 2010/042891 A2 | 4/2010 | |
| WO | WO-2010042562 A2 * | 4/2010 | ......... C07K 16/3092 |
| WO | 2013/059373 A2 | 4/2013 | |
| WO | 2013/157102 A1 | 10/2013 | |
| WO | 2014/018679 A2 | 1/2014 | |
| WO | 2014/028668 A2 | 2/2014 | |
| WO | WO-2014055657 A1 | 4/2014 | |
| WO | 2014/130741 A2 | 8/2014 | |
| WO | 2015/009740 A2 | 1/2015 | |
| WO | 2015/157322 A2 | 10/2015 | |
| WO | WO-2016130726 A1 | 8/2016 | |

OTHER PUBLICATIONS

Strome, Scott E. et al., "A Mechanistic Perspective of Monoclonal Antibodies in Cancer Therapy Beyond Target-Related Effects," The Oncologist, vol. 12, pp. 1084-1095, 2007.

Aboud-Pirak et al., "Inhibition of human tumor growth in nude mice by a conjugate of doxorubicin with monoclonal antibodies to epidermal growth factor receptor," Proceedings of the National Academy of Sciences, vol. 86, pp. 3778-3781, May 1989.

Baeuerle et al., "Bispecific T Cell Engaging Antibodies for Cancer Therapy," Cancer Research, vol. 69, No. 12, pp. 4941-4944, Jun. 15, 2009.

Bortoletto et al., "Optimizing anti-CD3 affinity for effective T cell targeting against tumor cells," European Journal of Immunology, vol. 32, pp. 3102-3107, 2002.

Bruenke, J. et al., "Effective lysis of lymphoma cells with a stabilized bispecific single-chain Fv antibody against CD19 and FcgammaRIII (CD16)," British Journal of Haematology, vol. 130, No. 2, pp. 218-228, 2005.

Cao et al., "Construction and characterization of an enhanced GFP-tagged anti-BAFF scFv antibody," Applied Microbiology and Biotechnology, vol. 79, No. 3, pp. 423-431, 2008.

Chames and Baty, "Bispecific Antibodies for Cancer Therapy," Current Opinion Drug Discovery & Development, vol. 12, No. 2, pp. 276-283, 2009.

Finlay et al., "Affinity maturation of a humanized rat antibody for anti-RAGE therapy: comprehensive mutagenesis reveals a high level of mutational plasticity both inside and outside the complementarity-determining regions," Journal of Molecular Biology, vol. 388, No. 3, pp. 541-558, 2009.

Holliger, Phillip et al., "'Diabodies': Small bivalent and bispecific antibody fragments," Proceedings of the National Academy of Science, vol. 90, No. 14, pp. 6444-6448, Jul. 1993.

Hurwitz et al., "The covalent binding of daunomycin and adriamycin to antibodies, with retention of both drug and antibody activities," Cancer Research, vol. 35, No. 5, pp. 1175-1181, May 1975.

Jakobovits et al., "From XenoMouse technology to panitumumab, the first fully human antibody product from transgenic mice," Nature Biotechnology, vol. 25, No. 10, pp. 1134-1143, Oct. 2007.

Johansson et al., "Efficient expression of recombinant human monoclonal antibodies in Drosophila S2 cells," Journal of Immunological Methods, vol. 318, pp. 37-46, 2007.

Juarez-Gonzalez et al., "Directed Evolution, Phage Display and Combination of Evolved Mutants: A Strategy to Recover the Neutralization Properties of the scFv Version of BCF2 a Neutralizing Monoclonal Antibody Specific to Scorpion Toxin Cn2," Journal of Molecular Biology, vol. 346, pp. 1287-1297, 2005.

Kettleborough et al., "Optimization of primers for cloning libraries of mouse immunoglobulin genes using the polymerase chain reaction," European Journal of Immunology, vol. 23, pp. 206-211, 1993.

Lonberg, Nils, "Human antibodies from transgenic animals," Nature Biotechnology, vol. 23, No. 9, pp. 1117-1125, Sep. 2005.

Lu et al., "Simultaneous Blockade of Both the Epidermal Growth Factor Receptor and the Insulin-like Growth Factor Receptor Signaling Pathways in Cancer Cells with a Fully Human Recombinant Bispecific Antibody," Journal of Biological Chemistry, vol. 279, No. 4, pp. 2856-2865, Jan. 23, 2004.

Majors et al., "MCI-1 overexpression leads to higher viabilities and increased production of humanized monoclonal antibody in Chinese hamster ovary cells," Biotechnology Progress, vol. 25, No. 4, pp. 1161-1168, 2009.

McCall et al., "Isolation and characterization of an anti-CD16 single-chain Fv fragment and construction of an anti-HER2/neu/anti-CD16 bispecific scFv that triggers CD16-dependent tumor cytolysis," Molecular Immunology, vol. 36, No. 7, pp. 433-446, 1999.

McCarron et al., "Antibody Conjugates and Therapeutic Strategies," Molecular Interventions, vol. 5, No. 6, pp. 368-380, Dec. 2005.

Morrison, S.L., "Cloning, expression, and modification of antibody V regions," Current Protocols in Immunology, 2.12.1-2.12.17, 2002.

Muzard et al., "Design and humanization of a murine scFv that blocks human platelet glycoprotein VI in vitro," FEBS Journal, vol. 276, pp. 4207-4222, 2009.

Nahary and Benhar, "Chapter 3: Design of a human synthetic combinatorial library of single-chain antibodies," Therapeutic Antibodies: Methods and Protocols, vol. 525, pp. 61-80, 2009.

Razai et al., "Molecular evolution of antibody affinity for sensitive detection of botulinum neurotoxin type A," Journal of Molecular Biology, vol. 351, No. 1, pp. 158-169, 2005.

Robinson et al., "Targeting ErbB2 and ErbB3 with a bispecific single-chain Fv enhances targeting specificity and induces a therapeutic effect in vitro," British Journal of Cancer, vol. 99, No. 9, pp. 1415-1425, 2008.

Wang et al., "Universal PCR amplification of mouse immunoglobulin gene variable regions: The design of degenerate primers and an assessment of the effect of DNA polymerase 3' to 5' exonuclease activity," Journal of Immunological Methods, vol. 233, pp. 167-177, 2000.

(56) References Cited

OTHER PUBLICATIONS

Ikezoe, T et al., "A novel treatment strategy targeting Aurora kinases in acute myelogenous leukemia," Molecular Dancer Therapeutics, vol. 6, No. 6, pp. 1851-1857, May 31, 2007.
Brugger, W et al., "Expression of MUC-1 Epitopes on Normal Bone Marrow: Implications for the Detection of Micrometastatic Tumor Cells," Journal of Clinical Oncology, vol. 17, No. 5, pp. 1535-1544, May 1999.
Hikita, Sherry T et al., "MUC1* Mediates the Growth of Human Pluripotent Stem Cells," PLoS ONE, vol. 3, No. 10, e3312, pp. 1-13, Oct. 3, 2008.
Lyman, Gary H., "A comparison of international guidelines for the prevention of chemotherapy-induced neutropenia," Current Opinion in Hematology, vol. 18, pp. 1-10, 2001.
Bachmann, Martin F. et al., "Recall Proliferation Potential of Memory CD8+ T Cells and Antiviral Protection," The Journal of Immunology, vol. 175, pp. 4677-4685, 2005.
Efferson, Clay L., "Stimulation of Human T Cells by an Influenza A Vector Expressing a CTL Epitope from the HER-2/neu Protooncogene Results in Higher Numbers of Antigen-Specific TCRhi Cells than Stimulation with Peptide. Divergent Roles of IL-2 and IL-15," Anticancer Research, vol. 25, pp. 715-724, 2005.
Katayose, Yu et al., "MUC1-specific Targeting Immunotherapy with Bispecific Antibodies: Inhibition of Xenografted Human Bile Duct Carcinoma Growth," Cancer Research, vol. 56, pp. 4205-4212, Sep. 15, 1996.
Mahanta, Sanjeev, "A Minimal Fragment of MUC1 Mediates Growth of Cancer Cells," PLoS ONE, vol. 3, No. 4, e2054, pp. 1-12, Apr. 2008.
Wheeler, Cosette M., "Preventive vaccines for cervical cancer," Salud Publica de Mexico, vol. 39, No. 4, pp. 1-5, Jul.-Aug. 1997.
Harsough, Melanie T. et al., "Nm23/Nucleoside Diphosphate Kinase in Human Cancers," Journal of Bioenergetics and Biomembranes, vol. 32, No. 3, pp. 301-308, Jun. 2000.
Girling, A. et al., "A Core Protein Epitope of the Polymorphic Epithelial Mucin Detected by the Monoclonal Antibody SM-3 is Selectively Exposed in a Range of Primary Carcinomas," International Journal of Cancer, vol. 43, No. 6, pp. 1072-1076, 1989.
Pemberton, Lucy F. et al., "The Epithelial Mucin MUC1 Contains at Least Two Discrete Signals Specifying Membrane Localization in Cells," The Journal of Biological Chemistry, vol. 271, No. 4, pp. 2332-2340, Jan. 26, 1996.
Pemberton, Lucy et al., "Antibodies to the cytoplasmic domain of the MUC1 mucin show conservation throughout mammals," Biochemical and Biophysical Research Communications, vol. 185, No. 1, pp. 167-175, May 29, 1992.
Baldus, Stephan E. et al., "Correlation of the Immunohistochemical Reactivity of Mucin Peptide Cores MUC1 and MUC2 with the Histopathological Subtype and Prognosis of Gastric Carcinomas," International Journal of Cancer (Pred. Oncol.), vol. 79, pp. 133-138, 1998.
Blockzjil, Andries et al., "Epitope Characterization of MUC1 Antibodies," Tumor Biology, vol. 19 (suppl. 1), pp. 46-56, 1998.
Kufe, Donald et al., "Differential Reactivity of a Novel Monoclonal Antibody (DF3) with Human Malignant versus Benign Breast Tumors," Hybridoma, vol. 3, No. 3, pp. 223-232, 1984.
Gendler, Sandra J., "Molecular Cloning and Expression of Human Tumor-associated Polymorphic Epithelial Mucin*," The Journal of Biological Chemistry, vol. 265, No. 25, pp. 15286-15293, Sep. 5, 1990.
Byrd et al., "Deglycosylation of mucin from LS174T colon cancer cells by hydrogen fluoride treatment," Biochem. J., vol. 261, pp. 617-625, 1989.
Yonezawa et al., "Differential mucin gene expression in human pancreatic and colon cancer cells," Biochem. J., vol. 276, pp. 599-605, 1991.
Baeckstrom et al., "Purification and Characterization of a Membrane-bound and a Secreted Mucin-type Glycoprotein Carrying the Carcinoma-associated Sialyl-Lea Epitope on Distinct Core Proteins," The Journal of Biological Chemistry, vol. 266, No. 32, pp. 21537-21547, Nov. 15, 1991.
Muller, Stefan et al., "Localization of O-Glycosylation Sites on Glycopeptide Fragments from Lactation-associated MUC1," The Journal of Biological Chemistry, vol. 272, No. 40, pp. 24780-24793, Oct. 3, 1997.
Yang, Doo-Hyun et al., "Identification of Glycosylated 38-kDa Connective Tissue Growth Factor (IGFBP-Related Protein 2) and Proteolytic Fragments in Human Biological Fluids, and Up-Regulation of IGFBP-rP2 Expression by TGF-beta in Hs578T Breast Cancer Cells," Journal of Clinical Endocrinology and Metabolism, vol. 83, No. 7, pp. 2593-2596, 1998.
Devine, Peter L. et al., "Expression of MUC1 and MUC2 Mucins by Human Tumor Cell Lines," Tumor Biology, vol. 13, pp. 268-277, 1992.
Burgess, W. H. et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," The Journal of Cell Biology, vol. 111, pp. 2129-2138, Nov. 1990.
Chen, Lin-Chi et al., "Labeling of Proteins with [35S] Methionine and/or [35S] Cysteine in the Absence of Cells," Analytical Biochemistry, vol. 269, pp. 179-188, 1999.
Fraley et al., "New generation liposomes: the engineering of an efficient vehicle for intracellular delivery of nucleic acids," Trends in Biochemical Sciences, vol. 6, pp. 77-80, 1981.
Gregoriadis, Gregory, "Liposomes for drugs and vaccines," Trends in Biotechnology, vol. 3, No. 9, pp. 235-241, Sep. 1985.
Hartman, Mor-li et al., "MUC1 Isoform Specific Monoclonal Antibody 6E6/2 Detects Preferential Expression of the Novel MUC1/Y Protein in Breast and Ovarian Cancer," Int. J. Cancer, vol. 82, pp. 256-267, 1999.
Hieken et al., "Beta3 Integrin Expression in Melanoma Predicts Subsequent Metastasis," Journal of Surgical Research, vol. 63, No. 1, pp. 169-173, Jun. 1996.
Horton, Michael A., "The alphavbeta3 Integrin 'Vitronectin Receptor'," Int. J. Biochem. Cell Biol., vol. 29, No. 5, pp. 721-725, 1997.
ImmunoGlobe GmbH, "The Art of Selecting an Epitope," pp. 1-3, Sep. 14, 2011.
Lan, Michael S. et al., "Cloning and Sequencing of a Human Pancreatic Tumor Mucin cDNA," The Journal of Biological Chemistry, vol. 265, No. 25, pp. 15294-15299, Sep. 5, 1990.
Lazar, Eliane et al., "Transforming Growth Factor alpha: Mutation of Aspartic Acid 47 and Leucine 48 Results in Different Biological Activities," Molecular and Cellular Biology, vol. 8, No. 3, pp. 1247-1252, Mar. 1988.
Ligtenberg et al., "Cell-associated episialin is a complex containing two proteins derived from a common precursor," The Journal of Biological Chemistry, vol. 267, No. 9, pp. 6171-6177, Mar. 1992.
Mao et al., "Loss of nm23 expression predicts distal metastases and poorer survival for breast cancer," Int. J. Oncol., vol. 18, No. 3, pp. 587-591, Mar. 2001.
Meerzaman, Daoud et al., "Involvement of the MAP kinase ERK2 in MUC1 mucin signaling," Am J Physiol Lung Cell Mol Physiol, vol. 281, pp. L86-L91, 2001.
Pegram et al., "Phase II study of receptor-enhanced chemosensitivity using recombinant humanized anti-p185HER2/neu monoclonal antibody plus cisplatin in patients with HER2/neu-overexpressing metastatic breast cancer refractory to chemotherapy treatment," Journal of Clinical Oncology, vol. 16, pp. 2659-2671, 1998.
Ross, Jeffrey S. et al., "The HER-2/neu Oncogene in Breast Cancer: Prognostic Factor, Predictive Factor, and Target for Therapy," Stem Cells, vol. 16, pp. 413-428, 1998.
Sawhney, Amarpreet S. et al., "Bioerodible Hydrogels Based on Photopolymerized Poly(ethylene glycol)-co-poly (alpha-hydroxy acid) Diacrylate Macromers," Macromolecules, vol. 26, pp. 581-587, 1993.
Schneider et al., "Nm23 expression in advanced and borderline ovarian carcinoma," Anticancer Res., vol. 16(3A), pp. 1197-1202, May-Jun. 1996.

(56) References Cited

OTHER PUBLICATIONS

Skolnick, Jeffrey et al., "From genes to protein structure and function: novel applications of computational approaches in the genomic era," Trends in Biotechnology, vol. 18, No. 1, pp. 34-39, 2000.

Spicer, Andrew P. et al., "Molecular Cloning and Analysis of the Mouse Homologue of the Tumor-associated Mucin, MUC1, Reveals Conservation of Potential O-Glycosylation Sites, Transmembrane, and Cytoplasmic Domains and a Loss of Minisatellite-like Polymorphism," The Journal of Biological Chemistry, vol. 266, No. 23, pp. 15099-15109, Aug. 15, 1991.

Treon, Steven P. et al., "Muc-1 Core Protein is Expressed on Multiple Myeloma Cells and is Induced by Dexamethasone," Blood, vol. 93, No. 4, pp. 1287-1298, 1999.

Vailhe et al., "In vitro angiogenesis is modulated by the mechanical properties of fibrin gels and is related to alpha(v) beta3 integrin localization," In Vitro Cell Dev Biol Anim., vol. 33, No. 10, pp. 763-773, Nov.-Dec. 1997.

Varner, Judith A. et al., "Integrins and cancer," Current Opinion in Cell Biology, vol. 8, pp. 724-730, 1996.

Wilkie, Scott et al., "Retargeting of Human T Cells to Tumor-Associated MUC1: The Evolution of a Chimeric Antigen Receptor," The Journal of Immunology, vol. 180, pp. 4901-4909, 2008.

Wilkinson et al., "Monovalent IgG4 molecules", mAbs, 5:3, 406-417, 18 pages, 2013, https://doi.org/10.4161/mabs.23941, Apr. 8, 2013.

Ma, Yi-dong et al., Specific cytotoxicity of MUC1 chimeric antigen receptor-engineered Jurkat T cells against hepatocellular carcinoma, Academic Journal of Second Military Medical University, Nov. 2014, vol. 35, No. 11, pp. 1177-1182.

Baker et al., "Humanization of an Anti-Mucin Antibody for Breast and Ovarian Cancer Therapy", Antigen and Antibody Molecular Engineering in Breast Cancer Diagnosis and Treatment, Edited by R.L. Ceriani, Plenum Press, New York, 1994, Adv. Exp. Med. Biol.,1994—82 (Documents indicating well-known arts), vol. 353,ps. 61-82.

Mazor et al., "Humanization and epitope mapping of the H23 anti-MUC1 monoclonal antibody reveals a dual epitope specificity", Molecular Immunology, 2005—69 (Documents indicating well-known arts), vol. 42,p. 55-69.

Czajkowsky, et al. Fc-fusion proteins: new developments and future perspectives. EMBO Mol Med. Oct. 2012; 4(10): 1015-1028. Published online Jul. 26, 2012.

Dai et al. Chimeric Antigen Receptors Modified T-Cells for Cancer Therapy. J Natl Cancer Inst. 108(7):djv439 (2016).

Fessler et al. MUC1* is a determinant of trastuzumab (Herceptin) resistance in breast cancer cells. Breast Cancer Res Treat 118:113-134 (2009).

Hombach et al. 0X40 costimulation by a chimericantigen receptor abrogates CD28 and IL-2 induced IL-10 secretion by redirectedCD4(+) T cells. Oncoimmunology 1(4):458-466 (2012).

Kowolik et al. CD28 costimulation provided through a CD19-specific chimeric antigen receptor enhances in vivo persistence and antitumor efficacy of adoptively transferred T cells. Cancer Res 66(22):10995-11004 (2006).

Loskog et al. Addition of the CD28 signaling domain to chimeric T-cell receptors enhances chimeric T-cell resistance to T regulatory cells. Leukemia 20(10):1819-1828 (2006).

Milone et al. Chimeric receptors containing CD137 signal transduction domains mediate enhanced survival of T cells and increased antileukemic efficacy in vivo. Mol Ther 17(8):1453-1464 (2009).

PCT/US2016/017422 International Search Report and Written Opinion dated Jul. 26, 2016.

Pule et al. A chimeric T cell antigen receptor that augments cytokine release and supports clonal expansion of primary human T cells. Mol Ther 12(5):933-941 (2005).

Song et al. In Vivo Persistence, Tumor Localization, and Antitumor Activity of CAR-Engineered T Cells is Enhanced by Costimulatory Signaling through CD137 (4-1BB). Cancer Res 71(13):4617-4627 (2011).

Strausberg et al., Generation and initial analysis of more than 15,000 full-length human and mouse cDNA sequences, Proc. Natl. Acad. Sci. U.S.A. 99 (26), 16899-16903 (2002).

Ellison et al., "Linkage and sequence homology of two human immunoglobulin gamma heavy chain constant region genes", Proc. Natl. Acad. Sci. U.S.A. 79 (6), 1984-1988 (1982).

(Abstract) Paterson et al., "Variation in IgG1 heavy chain allotype does not contribute to differences in biological activity of two human anti-Rhesus (D) monoclonal antibodies", Immunotechnology 4(1), 37-47 (1998).

(Abstract) Pilkington et al., "Recombinant human Fab antibody fragments to HIV-1 Rev and Tat regulatory proteins: direct selection from a combinatorial phage display library", Mol. Immunol. 33 (4-5), 439-450 (1996).

(Abstract) Gottlieb et al., "The covalent structure of a human gamma C-immunoglobulin. V1. Amino acid sequence of the light chain", Biochemistry 9 (16), 3155-3161 (1970).

Salek et al., "Quantitative phosphoproteome analysis unveils LAT as a modulator of CD3zeta and ZAP-70 tyrosine phosphorylation", PLoS ONE 8 (10), E77423 (2013) J15.

Bakhtiari et al. Anti-MUC1 nanobody can redirect T-body cytotoxic effector function. Hybridoma (Larchmt). 28(2):85-92 (2009).

Iri-Sofla et al. Nanobody-based chimeric receptor gene integration in Jurkat cells mediated by φC31 integrase. Exp Cell Res 317(18):2630-2641 (2011).

U.S. Appl. No. 16/539,247 Office Action dated Jun. 1, 2022.

U.S. Appl. No. 16/539,247 Terminal Disclaimer filed Aug. 30, 2022.

Macian. NFAT Proteins: Key Regulators of T-Cell Development and Function. Nat. Rev. Immunol. 5(6):472-84 (2005).

Panka et al. Variable region framework differences result in decreased or increased affinity of variant anti-digoxin antibodies. PNAS USA 85:3080-3084 (1988).

Rudikoff et al.: Single amino acid substitution altering antigen-binding specificity. Proc Natl Acad Sci U S A. 79(6):1979-83 (1982).

U.S. Appl. No. 17/817,515 Office Action dated Jan. 10, 2023.

* cited by examiner

HUMANIZED ANTI-MUC1* ANTIBODIES

BACKGROUND OF THE INVENTION

1. Field of the Invention

The present application relates to humanized anti-MUC1* antibodies and methods of making and using them.

2. General Background and State of the Art

We previously discovered that a cleaved form of the MUC1 (SEQ ID NO:1) transmembrane protein is a growth factor receptor that drives the growth of over 75% of all human cancers. The cleaved form of MUC1, which we called MUC1* (pronounced muk 1 star), is a powerful growth factor receptor. Cleavage and release of the bulk of the extracellular domain of MUC1 unmasks a binding site for activating ligands dimeric NME1, NME6 or NME7. It is an ideal target for cancer drugs as it is aberrantly expressed on over 75% of all cancers and is likely overexpressed on an even higher percentage of metastatic cancers (Fessler S P, Wotkowicz M T, Mahanta SK and Bamdad C. (2009). MUC1* is a determinant of trastuzumab (Herceptin) resistance in breast cancer cells.Breast Cancer Res Treat. 118 (1):113-124). After MUC1 cleavage most of its extracellular domain is shed from the cell surface. The remaining portion has a truncated extracellular domain that at least comprises the primary growth factor receptor sequence, PSMGFR (SEQ ID NO:2).

Antibodies are increasingly used to treat human diseases. Antibodies generated in non-human species have historically been used as therapeutics in humans, such as horse antibodies. More recently, antibodies are engineered or selected so that they contain mostly human sequences in order to avoid a generalized rejection of the foreign antibody. The process of engineering recognition fragments of a non-human antibody into a human antibody is generally called 'humanizing'. The amount of non-human sequences that are used to replace the human antibody sequences determines whether they are called chimeric, humanized or fully human.

Alternative technologies exist that enable generation of humanized or fully human antibodies. These strategies involve screening libraries of human antibodies or antibody fragments and identifying those that bind to the target antigen, rather than immunizing an animal with the antigen. Another approach is to engineer the variable region(s) of an antibody into an antibody-like molecule. The present invention is intended to also encompass these approaches for use with recognition fragments of antibodies that the inventors have determined bind to the extracellular domain of MUC1*.

In addition to treating patients with an antibody, cancer immunotherapies have recently been shown to be effective in the treatment of cancers. T-cell based cancer immunotherapy is an attractive approach to overcome the cancer cells evasion from the immune system. A first immunotherapy, called CAR T (chimeric antigen receptor T cell) therapy relies on the expression of a CAR on the surface of the patient T cells for adoptive T-cell therapy (Dai H, Wang Y, Lu X, Han W. (2016) Chimeric Antigen Receptors Modified T-Cells for Cancer Therapy. J Natl Cancer Inst. 108(7): djv439). Such receptor is composed of an anti cancer scFv linked to a T cell transmembrane and signaling domains. Upon binding of the receptor to a cancer associated antigen, a signal is transmitted resulting in T-cell activation, propagation and the targeted killing of the cancer cells. In practice, a patient's T cells are isolated and transduced with a CAR, expanded and then injected back into the patient. When the patient's CAR T cells bind to the antigen on a cancer cell, the CAR T cells expand and attack the cancer cells. A drawback of this method is the risk of activating the patient's immune system to destroy cells bearing the target antigen, when most cancer antigens are expressed on some healthy tissues, but overexpressed on cancerous tissues. To minimize the risk of off-tumor/on-target effects, the cancer antigen should be minimally expressed on healthy tissues.

A second cancer immunotherapy involves BiTEs (Bi-specific T cell Engagers). The BiTE approach attempts to eliminate the CAR T associated risk of off-tumor/on-target effects. Unlike CAR T, BiTEs are bispecific antibodies that should not pose any greater risk than regular antibody-based therapies. However, unlike typical anti-cancer antibodies that bind to and block a cancer antigen, BiTEs are designed to bind to an antigen on the tumor cell and simultaneously bind to an antigen on an immune cell, such as a T cell. In this way, a BiTE recruits the T cell to the tumor. BiTEs are engineered proteins that simultaneously bind to a cancer associated antigen and a T-cell surface protein such as CD3-epsilon. BiTEs are antibodies made by genetically linking the scFv's of an antibody that binds to a T cell antigen, like anti-CD3-epsilon to a scFv of a therapeutic monoclonal antibody that binds to a cancer antigen (Patrick A. Baeuerle, and Carsten Reinhardt (2009) Bispecific T-cell engaging antibodies for cancer therapy. Cancer Res. 69(12): 4941-4944).

SUMMARY OF THE INVENTION

In one aspect, the present invention is directed to a human or humanized anti-MUC1* antibody or antibody fragment or antibody-like protein that binds to a region on extracellular domain of MUC1 isoform or cleavage product that is devoid of the tandem repeat domains. The human or humanized anti-MUC1* antibody or antibody fragment or antibody-like protein may specifically bind to
  (i) PSMGFR region of MUC1;
  (ii) PSMGFR peptide;
  (iii) a peptide having amino acid sequence of

```
                                        (SEQ ID NO: 620)
    SNIKFRPGSVVVQLTLAFREGTINVHDVETQFNQYKTEAASRY;
```

(iv) a peptide

```
                                        (SEQ ID NO: 621)
    SVVVQLTLAFREGTINVHDVETQFNQYKTEAASRY;
``` having amino acid sequence of
  (v) a peptide having amino acid sequence of VQLTLAFREGTINVHDVETQFNQY (SEQ ID NO:622); or
  (vi) a peptide having amino acid sequence of SNIKFRPGSVVVQLTLAFREGTIN (SEQ ID NO:623).

The human or humanized antibody may be IgG1, IgG2, IgG3, IgG4 or IgM. The human or humanized antibody fragment or antibody-like protein may be scFv or scFv-Fc.

The human or humanized antibody, antibody fragment or antibody-like protein as in above may comprise a heavy chain variable region and light chain variable region which is derived from mouse monoclonal MN-E6 antibody, and has at least 80%, 90% or 95% or 98% sequence identity to the mouse monoclonal MN-E6 antibody. The heavy chain variable region may have at least 90% or 95% or 98% sequence identity to SEQ ID NO:13 and the light chain variable region may have at least 90% or 95% or 98% sequence identity to SEQ ID NO:66.

The human or humanized antibody, antibody fragment or antibody-like protein according to above may include complementarity determining regions (CDRs) in the heavy chain variable region and light chain variable region having at least 90% or 95% or 98% sequence identity to CDR1, CDR2 or CDR3 regions having sequence as follows:
CDR1 heavy chain SEQ ID NO:17
CDR1 light chain SEQ ID NO:70,
CDR2 heavy chain SEQ ID NO:21
CDR2 light chain SEQ ID NO:74,
CDR3 heavy chain SEQ ID NO:25
CDR3 light chain SEQ ID NO:78.

The human or humanized antibody, antibody fragment or antibody-like protein described above may include a heavy chain variable region and light chain variable region which is derived from mouse monoclonal MN-C2 antibody, and has at least 80%, 90% or 95% or 98% sequence identity to the mouse monoclonal MN-C2 antibody. The heavy chain variable region may have at least 90% or 95% or 98% sequence identity to SEQ ID NO:119 and the light chain variable region has at least 90% or 95% or 98% sequence identity to SEQ ID NO:169. The complementarity determining regions (CDRs) in the heavy chain variable region and light chain variable region may have at least 90% or 95% or 98% sequence identity to CDR1, CDR2 or CDR3 regions having sequence as follows:
CDR1 heavy chain SEQ ID NO:123
CDR1 light chain SEQ ID NO:173,
CDR2 heavy chain SEQ ID NO:127
CDR2 light chain SEQ ID NO:177,
CDR3 heavy chain SEQ ID NO:131
CDR3 light chain SEQ ID NO:181.

The human or humanized antibody, antibody fragment or antibody-like protein as in above may include a heavy chain variable region and light chain variable region which is derived from mouse monoclonal MN-C3 antibody, and may have at least 80%, 90% or 95% or 98% sequence identity to the mouse monoclonal MN-C3 antibody. The heavy chain variable region may have at least 90% or 95% or 98% sequence identity to SEQ ID NO:414 and the light chain variable region may have at least 90% or 95% or 98% sequence identity to SEQ ID NO:459. The complementarity determining regions (CDRs) in the heavy chain variable region and light chain variable region may have at least 90% or 95% or 98% sequence identity to CDR1, CDR2 or CDR3 regions having sequence as follows:
CDR1 heavy chain SEQ ID NO:418
CDR1 light chain SEQ ID NO:463,
CDR2 heavy chain SEQ ID NO:422
CDR2 light chain SEQ ID NO:467,
CDR3 heavy chain SEQ ID NO:426,
CDR3 light chain SEQ ID NO:471.

The human or humanized antibody, antibody fragment or antibody-like protein described above may include a heavy chain variable region and light chain variable region which is derived from mouse monoclonal MN-C8 antibody, and has at least 80%, 90% or 95% or 98% sequence identity to the mouse monoclonal MN-C8 antibody. The heavy chain variable region may have at least 90% or 95% or 98% sequence identity to SEQ ID NO:506 and the light chain variable region may have at least 90% or 95% or 98% sequence identity to SEQ ID NO:544. The complementarity determining regions (CDRs) in the heavy chain variable region and light chain variable region may have at least 90% or 95% or 98% sequence identity to CDR1, CDR2 or CDR3 regions having sequence as follows:
CDR1 heavy chain SEQ ID NO:508
CDR1 light chain SEQ ID NO:546,
CDR2 heavy chain SEQ ID NO:510
CDR2 light chain SEQ ID NO:548,
CDR3 heavy chain SEQ ID NO:512,
CDR3 light chain SEQ ID NO:550.

In another aspect, the present invention is directed to an anti-MUC1* extracellular domain antibody comprised of sequences of a humanized MN-E6 represented by humanized IgG2 heavy chain, or humanized IgG1 heavy chain, paired with humanized Kappa light chain, or humanized Lambda light chain. The humanized IgG2 heavy chain may be SEQ ID NOS:53, humanized IgG1 heavy chain may be SEQ ID NO:57, humanized Kappa light chain may be SEQ ID NO:108, and humanized Lambda light chain may be SEQ ID NO:112, or a sequence having 90%, 95% or 98% sequence identity thereof.

In another aspect, the invention is directed to an anti-MUC1* extracellular domain antibody comprised of sequences of a humanized MN-C2 represented by humanized IgG1 heavy chain, humanized IgG2 heavy chain, paired with humanized Lambda light chain, and humanized Kappa light chain. The humanized IgG1 heavy chain MN-C2 may be SEQ ID NOS:159 or IgG2 heavy chain may be SEQ ID NOS:164 paired with Lambda light chain (SEQ ID NO:219) or Kappa light chain (SEQ ID NO:213), or a sequence having 90%, 95% or 98% sequence identity thereof.

In another aspect, the invention is directed to an anti-MUC1* extracellular domain antibody comprised of sequences of a humanized MN-C3 represented by humanized IgG1 heavy chain or humanized IgG2 heavy chain paired with humanized Lambda light chain or humanized Kappa light chain. The humanized MN-C3 IgG1 heavy chain may be SEQ ID NOS:454, IgG2 heavy chain may be SEQ ID NOS:456, Lambda light chain may be SEQ ID NO:501, and Kappa light chain may be SEQ ID NO:503, or a sequence having 90%, 95% or 98% sequence identity thereof.

In another aspect, the invention is directed to an anti-MUC1* extracellular domain antibody comprised of sequences of a humanized MN-C8 represented by humanized IgG1 heavy chain or humanized IgG2 heavy chain paired with humanized Lambda light chain or humanized Kappa light chain. The humanized MN-C8 IgG1 heavy chain may be SEQ ID NOS:540, IgG2 heavy chain may be SEQ ID NOS:542, Lambda light chain may be SEQ ID NO:580 and Kappa light chain may be SEQ ID NO:582, or a sequence having 90%, 95% or 98% sequence identity thereof.

In another aspect, the invention is directed to a human or humanized anti-MUC1* antibody or antibody fragment or antibody-like protein according to above, which inhibits the binding of NME protein to MUC1*. The NME may be NME1, NME6, NME7AB, NME7 or NME8.

In yet another aspect, the invention is directed to a single chain variable fragment (scFv) comprising a heavy and light chain variable regions connected via a linker, further comprising CDRs of antibodies that bind to MUC1* extracellular domain. The CDRs may be derived from MN-E6, MN-C2, MN-C3 or MN-C8 antibodies or humanized antibodies thereof. The scFv may be one that possesses the SEQ ID NOS:233, 235 and 237 (E6); SEQ ID NOS:239, 241, and 243 (C2); SEQ ID NOS:245, 247, and 249 (C3); or SEQ ID NOS:251, 253, and 255 (C8).

In still another aspect, the invention is directed to a chimeric antigen receptor (CAR) comprising a scFv or a humanized variable region that binds to the extracellular domain of a MUC1 that is devoid of tandem repeats, a linker molecule, a transmembrane domain and a cytoplasmic domain. The single chain antibody fragment may bind to (i) PSMGFR region of MUC1,
(ii) PSMGFR peptide,
(iii) a peptide having amino acid sequence

```
                                         (SEQ ID NO: 620)
SNIKFRPGSVVVQLTLAFREGTINVHDVETQFNQYKTEAASRY;
```

(iv) a peptide having amino acid sequence of

```
                                         (SEQ ID NO: 621)
SVVVQLTLAFREGTINVHDVETQFNQYKTEAASRY;
```

(v) a peptide having amino acid sequence of VQLT-LAFREGTINVHDVETQFNQY (SEQ ID NO:622); or
(vi) a peptide having amino acid sequence of SNIKFRPGSVVVQLTLAFREGTIN (SEQ ID NO:623).

In the CAR as describe above, portions of any of the variable regions set forth and described above, or combination thereof may be used in the extracellular domain, a transmembrane region and a cytoplasmic tail that comprises sequence motifs that signal immune system activation. The extracellular domain may be comprised of humanized single chain antibody fragments of an MN-E6 scFv, MN-C2 scFv, MN-C3 scFv or MN-C8 scFv.

In the CAR as described above, the extracellular domain include humanized single chain antibody fragments of an MN-E6 scFv set forth as SEQ ID NOS: 233, 235, or 237), MN-C2 scFv (SEQ ID NOS:239, 241, or 243), MN-C3 scFv (SEQ ID NOS: 245, 247, or 249) or MN-C8 scFv (SEQ ID NOS:251, 253, or 255).

In any of the CAR described above, the cytoplasmic tail may be comprised of one or more of signaling sequence motifs CD3-zeta, CD27, CD28, 4-1BB, 0X40, CD30, CD40, PD-1, ICAm-1, LFA-1, ICOS, CD2, CD5, or CD7.

In any of the CAR described above, the sequence may be CARMN-E6 CD3z (SEQ ID NOS:295), CARMN-E6 CD28/CD3z (SEQ ID NOS:298); CARMN-E6 4-1BB/CD3z (SEQ ID NOS:301); CARMN-E6 0X40/CD3z (SEQ ID NOS:617); CARMN-E6 CD28/4-1BB/CD3z (SEQ ID NOS:304); CARMN-E6 CD28/0X40/CD3z (SEQ ID NOS: 619); CAR MN-C2 CD3z (SEQ ID NOS:607); CAR MN-C2 CD28/CD3z (SEQ ID NOS:609); CAR MN-C2 4-1BB/CD3z (SEQ ID NOS:611); CAR MN-C2 0X40/CD3z (SEQ ID NOS:613); CAR MN-C2 CD28/4-1BB/CD3z (SEQ ID NOS:307); or CAR MN-C2 CD28/0X40/CD3z (SEQ ID NOS:615).

In another aspect, the CAR may have an extracellular domain unit that recognizes a peptide. The peptide may be PSMGFR (SEQ ID NO:2). The peptide may be a peptide derived from NME7. The peptide may be

```
NME7A peptide 1 (A domain):
                                         (SEQ ID NO: 7)
MLSRKEALDFHVDHQS;

NME7A peptide 2 (A domain):
                                         (SEQ ID NO: 8)
SGVARTDASES;
```

```
NME7B peptide 1 (B domain):
                                         (SEQ ID NO: 9)
DAGFEISAMQMFNMDRVNVE;

NME7B peptide 2 (B domain):
                                         (SEQ ID NO: 10)
EVYKGVVTEYHDMVTE;
or NME7B peptide 3 (B domain):
                                         (SEQ ID NO: 11)
AIFGKTKIQNAVHCTDLPEDGLLEVQYFF.
```

In another aspect, the invention is directed a composition that includes at least two CARs with different extracellular domain units transfected into the same cell.

The at least two CARs may have one CAR that does not have a targeting recognition unit and the other CAR does have a targeting recognition unit. Or, one of the extracellular domain recognition units may bind to MUC1* extracellular domain. Or, one of the extracellular domain recognition units may bind PD-1. Or, one of the extracellular domain recognition units is an antibody fragment and the other is a peptide. Or, one is an anti-MUC1* scFv chosen from the group consisting of scFv of MN-E6 antibody, scFv of MN-C2 antibody, scFv of MN-C3 antibody or scFv of MN-C8 antibody and the other is a peptide derived from NME7 or chosen from the group consisting of

```
NME7A peptide 1 (A domain):
                                         (SEQ ID NO: 7)
MLSRKEALDFHVDHQS;

NME7A peptide 2 (A domain):
                                         (SEQ ID NO: 8)
SGVARTDASES;

NME7B peptide 1 (B domain):
                                         (SEQ ID NO: 9)
DAGFEISAMQMFNMDRVNVE;

NME7B peptide 2 (B domain):
                                         (SEQ ID NO: 10)
EVYKGVVTEYHDMVTE;
or NME7B peptide 3 (B domain):
                                         (SEQ ID NO: 11)
AIFGKTKIQNAVHCTDLPEDGLLEVQYFF.
```

In another aspect, the invention is directed to a cell comprising a CAR with an extracellular domain that binds to MUC1* transfected or transduced cell. The cell that includes the CAR may be an immune system cell, preferably a T cell or dendritic cell or mast cell.

In another aspect, the invention is directed to an engineered antibody-like protein.

In another aspect, the invention is directed to a method of screening a library of antibodies or antibody fragments that are human, for those that bind to (i) PSMGFR peptide;
(ii) a peptide having amino acid sequence

```
                                         (SEQ ID NO: 620)
SNIKFRPGSVVVQLTLAFREGTINVHDVETQFNQYKTEAASRY;
```

(iii) a peptide having amino acid sequence of

```
                                        (SEQ ID NO: 621)
    SVVVQLTLAFREGTINVHDVETQFNQYKTEAASRY;
```

(iv) a peptide having amino acid sequence of VQLT-LAFREGTINVHDVETQFNQY (SEQ ID NO:622);

(v) a peptide having amino acid sequence of SNIKFRPGSVVVQLTLAFREGTIN (SEQ ID NO:623);

(vi) NME7 protein; or (vii) a peptide fragment of NME7 protein.

In another aspect, the invention is directed to a method for treating a disease in a subject comprising administering an antibody according to any claim above, to a person suffering from the disease, wherein the subject expresses MUC1 aberrantly. The disease may be cancer, such as breast cancer, lung cancer, colon cancer, gastric cancer.

In another aspect, the invention is directed to a method for treating a disease in a subject comprising administering an NME peptide, to a person suffering from the disease, wherein the subject expresses MUC1 aberrantly.

In another aspect, the invention is directed to a method of proliferating or expanding stem cell population comprising contacting the cells with the antibody according to any method or composition described above.

In another aspect, the invention is directed to amethod of facilitating stem cell attachment to a surface comprising coating the surface with a humanized MN-C3 or MN-C8 antibody, antibody fragment or single chain antibody thereof and contacting stem cell to the surface.

In another aspect, the invention is directed to a method of delivering stem cell in vitro or in vivo comprising the steps of coating a surface with a humanized MN-C3 or MN-C8 antibody, antibody fragment or single chain antibody thereof, contacting the stem cell to the surface and delivering the stem cell to a specific location.

In another aspect, the invention is directed to a method of isolating stem cell comprising the steps of coating a surface with a humanized MN-C3 or MN-C8 antibody, antibody fragment or single chain antibody thereof, and contacting a mixed population of cells to the surface and isolating stem cell.

In another aspect, the invention is directed to a scFv comprising variable domain fragments derived from an antibody that binds to a extracellular domain of MUC1 isoform or cleavage product that is devoid of the tandem repeat domains. The variable domain fragments may be derived from mouse monoclonal antibody MN-E6 (SEQ ID NO:13 and 66) or from the humanized MN-E6 (SEQ ID NO: 39 and 94), or from MN-E6 scFv (SEQ ID NO: 233, 235 and 237). Or, the variable domain fragments may be derived from mouse monoclonal antibody MN-C2 (SEQ ID NO: 119 and 169) or from the humanized MN-C2 (SEQ ID NO: 145 and 195), or from MN-C2 scFv (SEQ ID NO: 239, 241 and 243). Or, the variable domain fragments may be derived from mouse monoclonal antibody MN-C3 (SEQ ID NO: 414 and 459) or from the humanized MN-C3 (SEQ ID NO: 440 and 487), or from MN-C3 scFv (SEQ ID NO: 245, 247 and 249). Or, the variable domain fragments may be derived from mouse monoclonal antibody MN-C8 (SEQ ID NO: 505 and 544) or from the humanized MN-C8 (SEQ ID NO: 526 and 566), or from MN-C8 scFv (SEQ ID NO: 251, 253, 255).

In another aspect, the invention is directed to a method for the treatment of a person diagnosed with, suspected of having or at risk of developing a MUC1 Or MUC1* positive cancer involving administering to the person an effective amount of the scFv described above.

In another aspect, the invention is directed to a scFv-Fc construct comprising the scFv as described above. The scFv-Fc may be dimerized. Or, the Fc component may be mutated so that scFv-Fc is monomeric. The mutation may include mutating or deleting hinge region on Fc, making F405Q, Y407R, T366W/L368W, and T364R/L368R mutation or combinations thereof on the Fc represented by SEQ ID NO: 281, 279, 285 and 287.

In another aspect, the invention is directed to a polypeptide comprising at least two different scFv sequences, wherein one of the scFv sequences is a sequence that binds to extracellular domain of MUC1 isoform or cleavage product that is devoid of the tandem repeat domains. The polypeptide may bind to (i) PSMGFR region of MUC1;

(ii) PSMGFR peptide;

(iii) peptide having amino acid sequence of

```
                                        (SEQ ID NO: 620)
    SNIKFRPGSVVVQLTLAFREGTINVHDVETQFNQYKTEAASRY;
```

(iv) a peptide

```
                                        (SEQ ID NO: 621)
    SVVVQLTLAFREGTINVHDVETQFNQYKTEAASRY;
``` having amino acid sequence of (v) a peptide having amino acid sequence of VQLT-LAFREGTINVHDVETQFNQY (SEQ ID NO:622); or (vi) a peptide having amino acid sequence of SNIKFRPGSVVVQLTLAFREGTIN (SEQ ID NO:623).

The polypeptide may bind to a receptor on an immune cell, such as T cell, and in particular, CD3 on T-cell.

In another aspect, the invention is directed to a method of detecting presence of a cell that expresses MUC1* aberrantly, comprising contacting a sample of cells with the scFv-Fc described above and detecting for the presence of the binding of scFv-Fc to the cell. The cell may be cancer cell.

In another aspect, the invention is directed to a method for testing a subject's cancer for suitability of treatment with a composition comprising portions of the variable regions of MN-E6, MN-C2, MN-C3 or MN-C8, comprising the steps of contacting a bodily specimen from the patient with the corresponding MN-E6 scFv-Fc, MN-C3 scFv-Fc, MN-C3 scFv-Fc or MN-C8 scFv-Fc.

In another aspect, the invention is directed to a method of treating a subject suffering from a disease comprising, exposing T cells from the subject to MUC1* peptides wherein through various rounds of maturation, T cells develop MUC1* specific receptors, creating adapted T cells, and expanding and administering the adapted T cells to the donor patient who is diagnosed with, suspected of having, or is at risk of developing a MUC1* positive cancer.

These and other objects of the invention will be more fully understood from the following description of the invention, the referenced drawings attached hereto and the claims appended hereto.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The present invention will become more fully understood from the detailed description given herein below, and the accompanying drawings which are given by way of illustration only, and thus are not limitative of the present invention, and wherein.

The CAR T cells were then exposed to MUC1* positive T47D breast cancer cells or MUC1* positive 1500 aka ZR-75-1 breast cancer cells. The ratio of MUC1* targeting CAR T cells to target cells was either 1:1 or 10:1. As can be seen from the graph, T cells transduced with a MUC1* targeting CAR have a much greater killing effect on MUC1* cancer cells than the untransduced control T cells. In addition, the killing effect is much greater when the ratio of T cells: target cells is increased.

Figure 37:
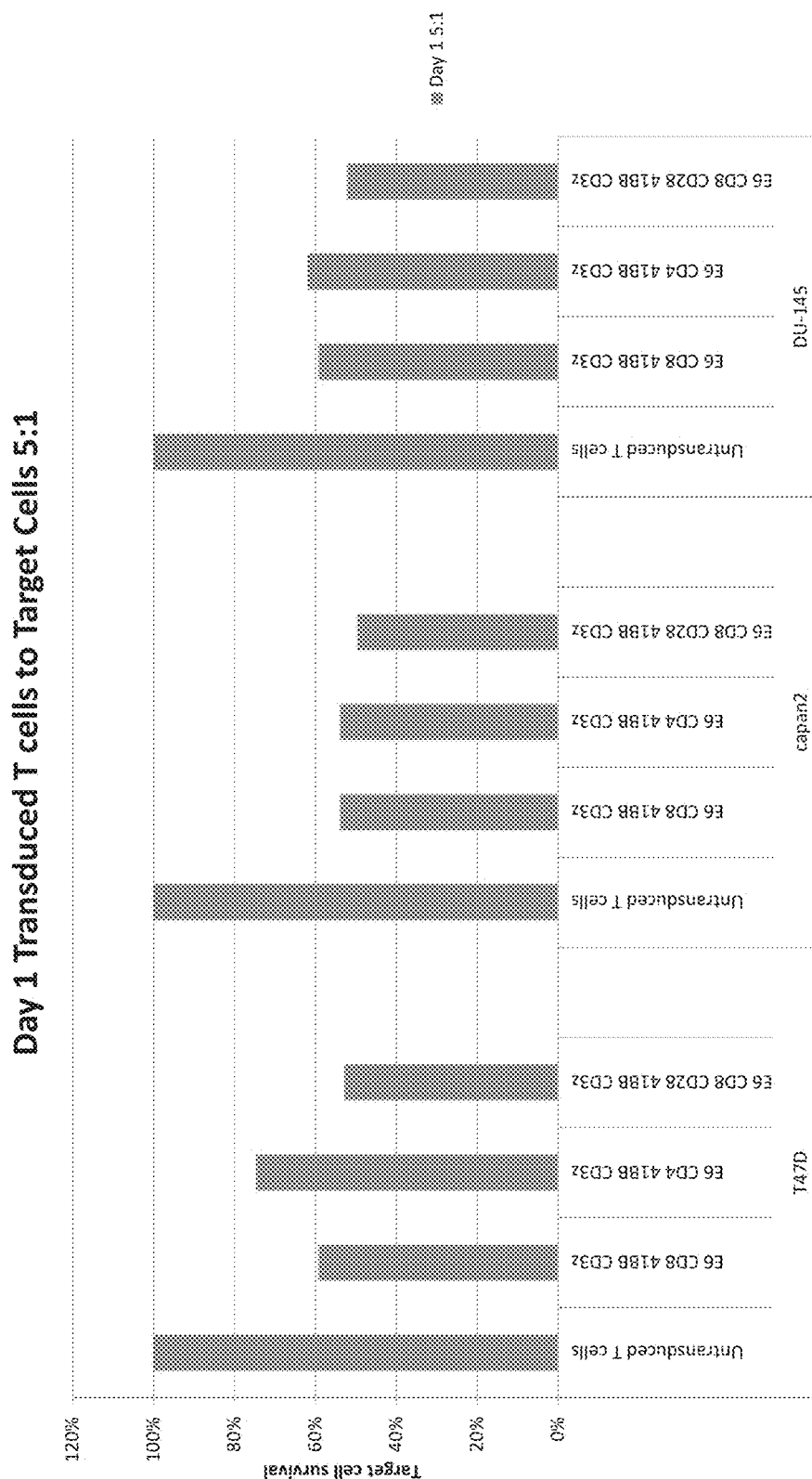

FIG. 37 is a graph of FACS measurements of target cell survival at Day 1 of co-culture experiment. Primary human T cells were transduced with a panel of CARs, including humanized MN-E6-CD8-41BB-3z, MN-E6-CD4-41BB-3z, and MN-E6-CD8-CD28-41BB-3z. The CAR T cells were then exposed to the following MUC1* positive cancer cells: T47D breast cancer; capan2 pancreatic cancer; or DU-145 prostate cancer. The ratio of MUC1* targeting CAR T cells to target cells was 5:1. As can be seen from the graph, T cells transduced with a MUC1* targeting CAR have a much greater killing effect on MUC1* cancer cells than the untransduced control T cells. Note that the measurements were taken after 24 hours with only a 5:1 T cell to target cell ratio. Also note that MUC1* targeting CARs that have a CD4 extracellular domain-transmembrane-cytoplasmic tail work equally well as CD8 constructs.

Figure 38:
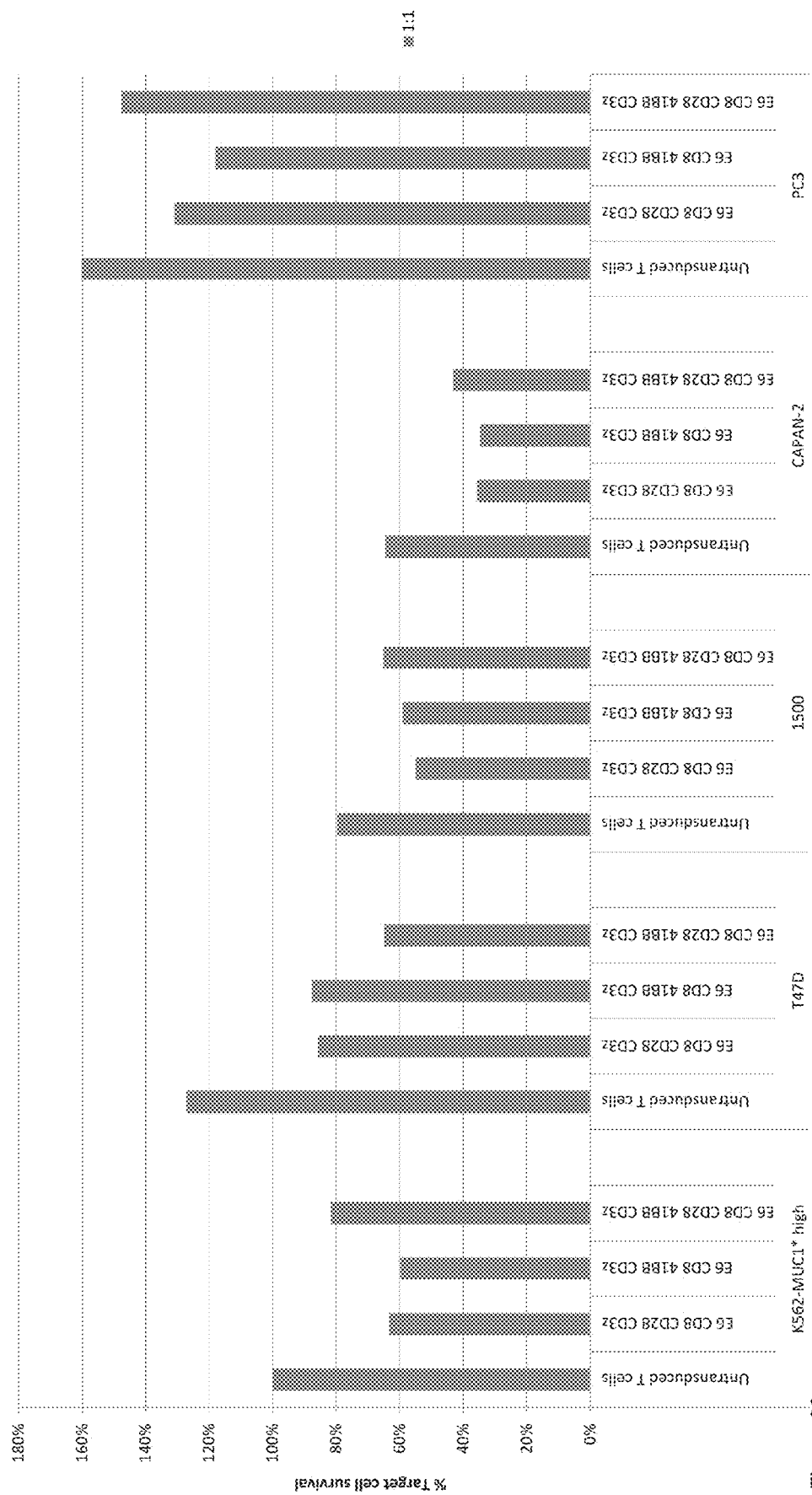

FIG. 38 is a graph of FACS measurements of target cell survival at Day 3 of co-culture experiment. Primary human T cells were transduced with a panel of CARs, including humanized MN-E6-CD8-41BB-3z, MN-E6-CD4-41BB-3z, and MN-E6-CD8-CD28-41BB-3z. The CAR T cells were then exposed to the following MUC1* positive cancer cells: K562 leukemia cells transfected with MUC1*; T47D breast cancer; 1500 aka ZR-75-1 breast cancer cells; or CAPAN-2 pancreatic cancer cells. In addition to the untransduced T cell controls, the assay was performed on PC3 MUC1* negative prostate cancer cells. The ratio of MUC1* targeting CAR T cells to target cells was 1:1. As can be seen from the graph, T cells transduced with a MUC1* targeting CAR have a much greater killing effect on MUC1* cancer cells than the untransduced control T cells. In addition, the killing effect is specific for MUC1* positive cells. Note that MUC1* targeting CARs that have a CD4 extracellular domain-transmembrane-cytoplasmic tail work equally well as CD8 constructs.

Figure 39:
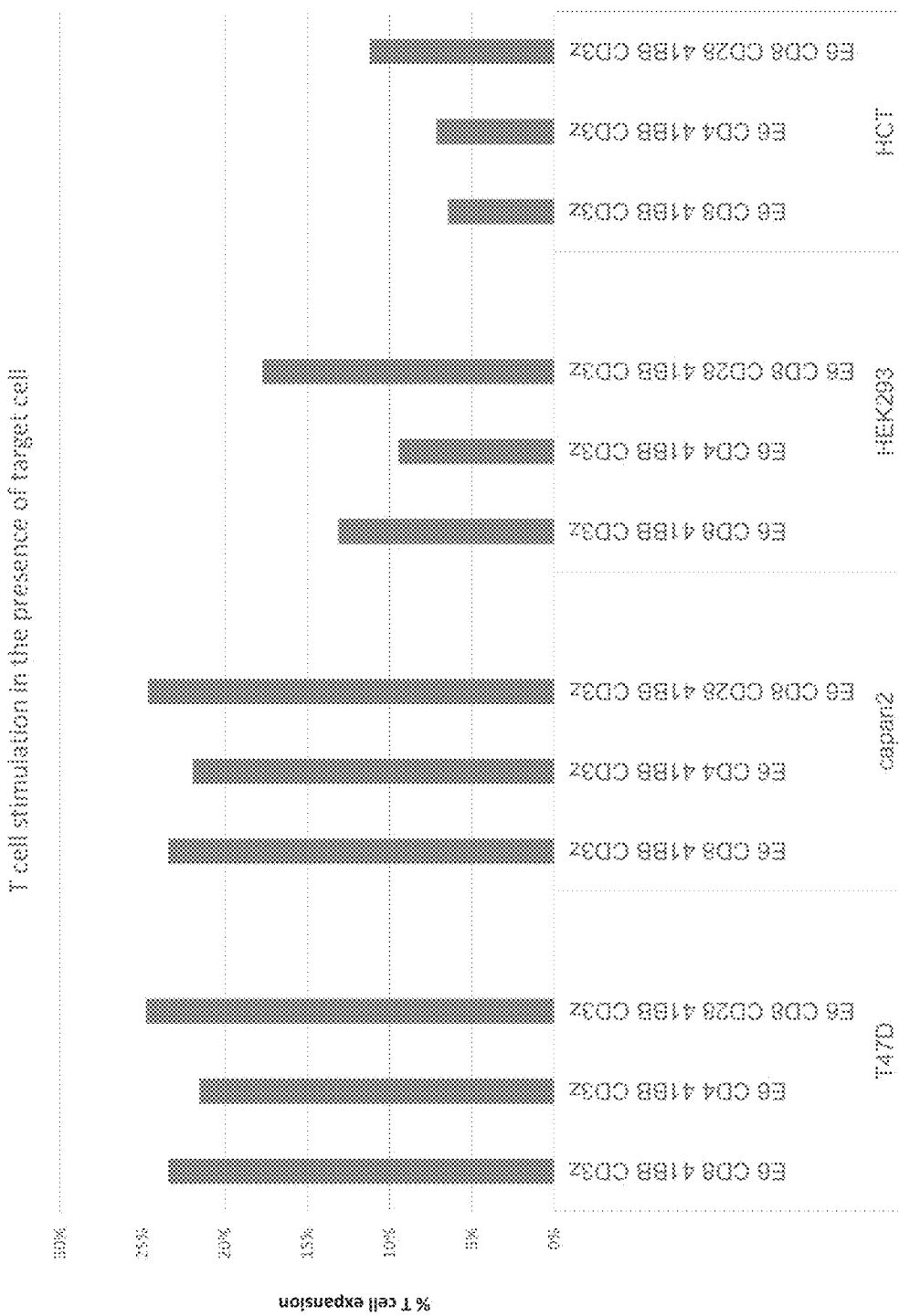

FIG. 39 is a graph of FACS measurements of CAR T cell expansion over 24 hours in co-culture with target cells at a ratio of 5:1 CAR T cells to target cells. The primary human T cells were transduced with a panel of CARs, including humanized MN-E6-CD8-41BB-3z, MN-E6-CD4-41BB-3z, and MN-E6-CD8-CD28-41BB-3z. The CAR T cells were co-cultured with MUC1* positive T47D breast cancer cells, MUC1* positive Capan pancreatic cancer cells, and MUC1-negative cells HCT-116 colon cancer cells and HEK-293 human embryonic kidney cells. As can be seen from the graph, the CAR T population is increased in the presence of MUC1* positive cells.

Figure 40:
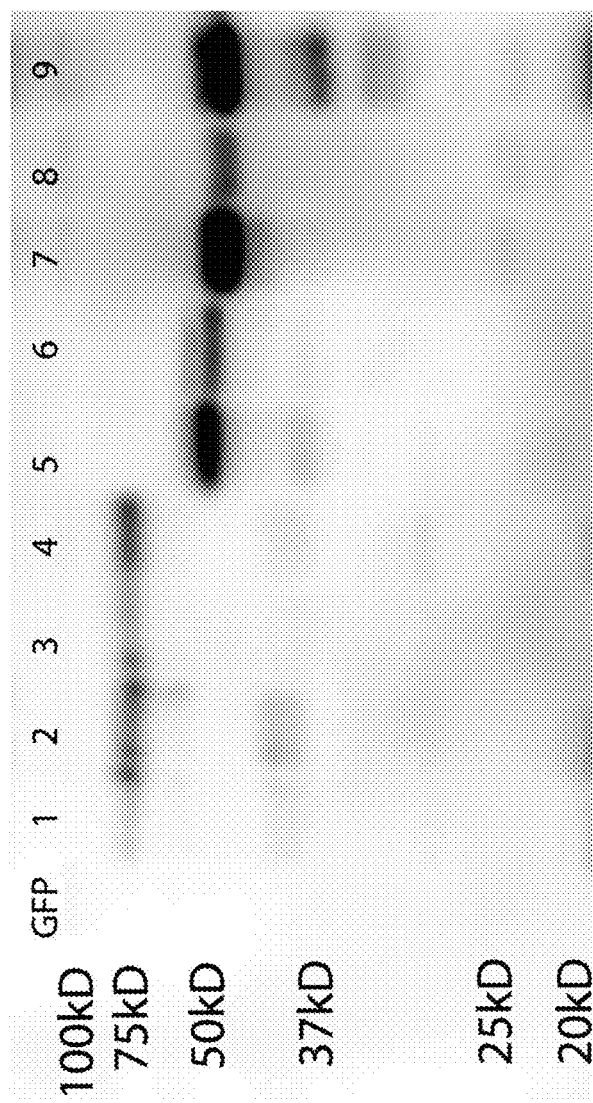

FIG. 40 shows a photograph of a Western blot of MUC1* targeting CARs. From 1 to 9 are:
1.E6scFv-Fc-8-41BB-CD3z (Human Fc as hinge region with CD8 TM);
2: E6scFv-FcH-8-41BB-CD3z (Human Fc hingeless as hinge region with CD8 TM)

3: E6scFv-Fc-4-41BB-CD3z (Human Fc as hinge region with CD4 TM)
4: E6scFv-FcH-4-41BB-CD3z (Human Fc as hingeless hinge region with CD4 TM)
5: E6scFv-IgD-8-41BB-CD3z (hinge region from human IgD with CD8 TM)
6: E6scFv-IgD-4-41BB-CD3z (hinge region from human IgD with CD4 TM)
7: E6scFv-X4-8-41BB-CD3z (Long flexible linker as hinge region with CD8 TM)
8: E6scFv-X4-4-41BB-CD3z (Long flexible linker as hinge region with CD4 TM)
9: E6scFv-8-4-41BB-CD3z (Hinge region from CD8 and CD4 a with CD4 TM).

Figure 41:
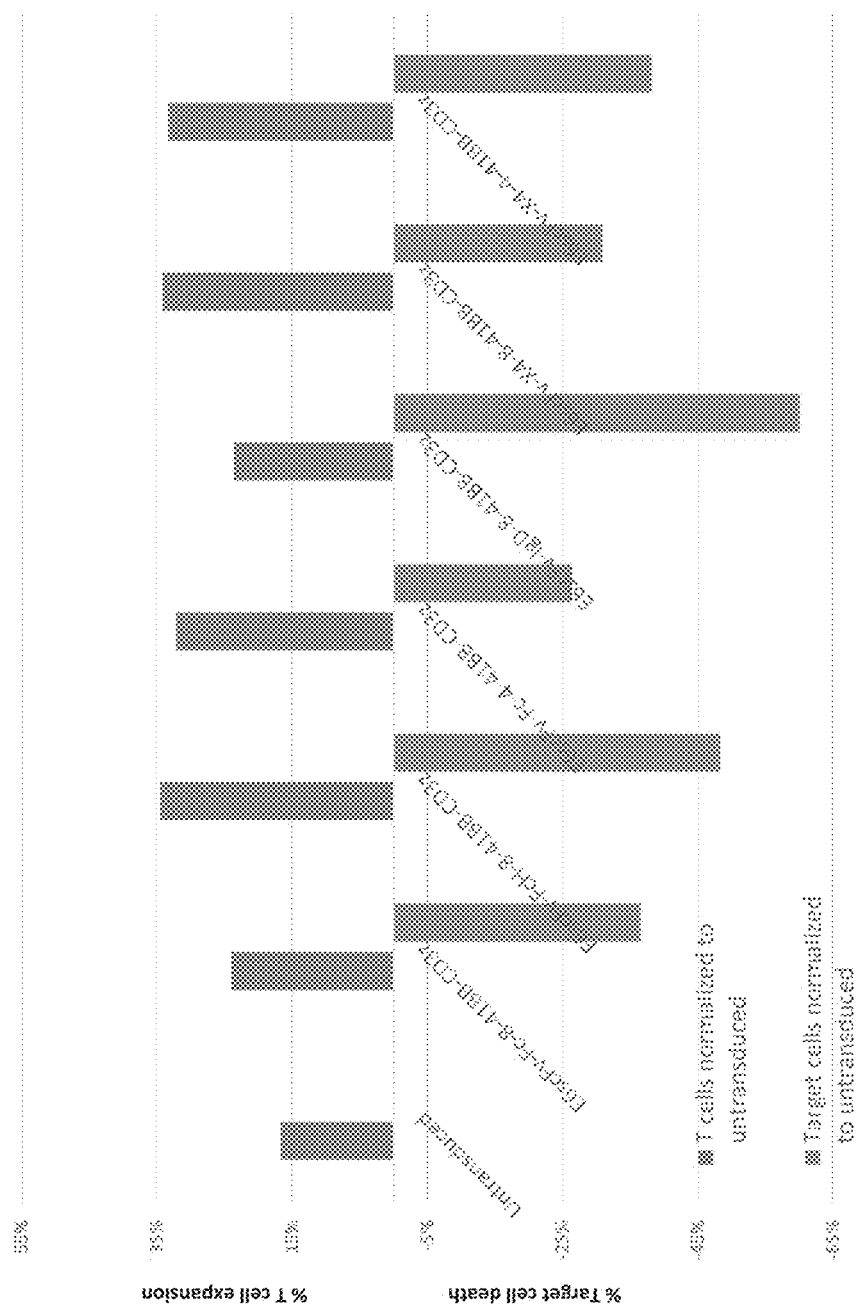

FIG. 41 shows graphs of FACS scans of T47D breast cancer cells co-cultured with human T cells that were transduced with MN-E6scFv-Fc-8-41BB-CD3z, MN-E6scFv-FcH-8-41BB-CD3z, MN-E6scFv-Fc-4-41BB-CD3z, MN-E6scFv-IgD-8-41BB-CD3z, MN-E6scFv-X4-8-41BB-CD3z and MN-E6scFv-X4-4-41BB-CD3z. T cells and cancer cells were co-cultured at a 1:1 ratio for 48 hours. T cell counts were normalized to an average of all untransduced T cells and target cells were normalized to each specific cell type when co-cultured with untransduced T cells. The graph shows that when the CAR T cells are co-cultured with MUC1* positive cancer cells, the T cell population expands and the targeted cancer cell population decreases.

Figure 42:
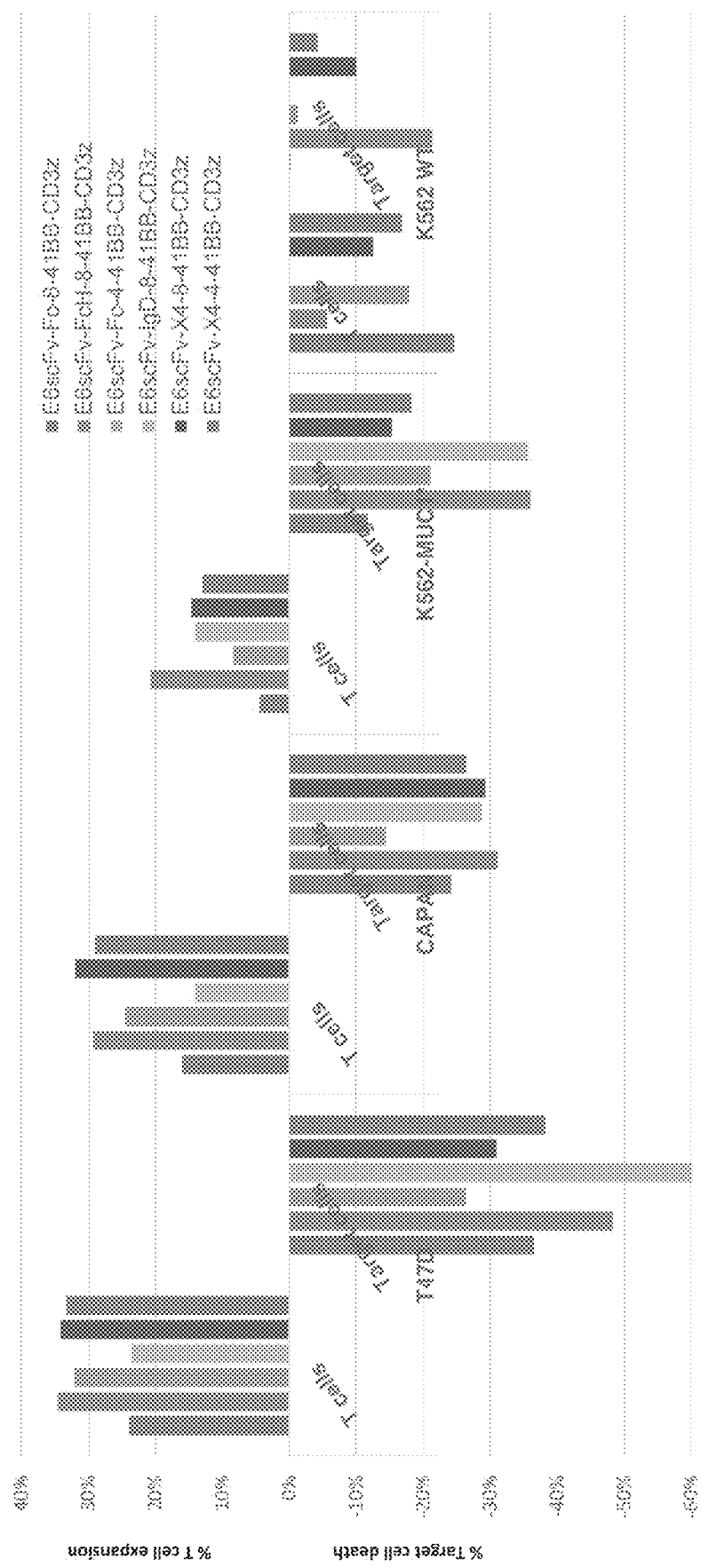

FIG. 42 shows graphs of FACS scans of T47D breast cancer cells, Capan-2 pancreatic cancer cells, K562-MUC1* transfected cells, and K562-wt cells that were co-cultured with human T cells that were transduced with MN-E6scFv-Fc-8-41BB-CD3z, MN-E6scFv-FcH-8-41BB-CD3z, MN-E6scFv-Fc-4-41BB-CD3 z, MN-E6scFv-IgD-8-41BB-CD3 z, MN-E6scFv-X4-8-41BB-CD3 z and MN-E6scFv-X4-4-41BB-CD3z. T cells and cancer cells were co-cultured at a 1:1 ratio for 48 hours. T cell counts were normalized to an average of all untransduced T cells and target cells were normalized to each specific cell type when co-cultured with untransduced T cells. The graph shows that when the CAR T cells are co-cultured with MUC1* positive cancer cells, the T cell population expands and the targeted cancer cell population decreases.

FIG. 43A,B are photographs of breast cancer tissue arrays. A) was stained with VU4H5 which recognizes MUC1-FL (full length); B) was stained with mouse monoclonal antibody MN-C2 which recognizes cancerous MUC1*. Following automated staining (Clarient Diagnostics), the tissue staining was scored using Allred scoring method which combines an intensity score and a distribution score. C,D,E,F are color coded graphs showing the score calculated for MUC1 full-length staining for each patient's tissue. G,H,I,J are color coded graphs showing the score calculated for MUC1* staining for each patient's tissue.

FIG. 44A,B are photographs of breast cancer tissue arrays. A) was stained with VU4H5 which recognizes MUC1-FL (full length); B) was stained with mouse monoclonal antibody MN-C2 which recognizes cancerous MUC1*. Following automated staining (Clarient Diagnostics), the tissue staining was scored using Allred scoring method which combines an intensity score and a distribution score. C,D,E,F are color coded graphs showing the score calculated for MUC1 full-length staining for each patient's tissue. G,H,I,J are color coded graphs showing the score calculated for MUC1* staining for each patient's tissue.

Figure 45:
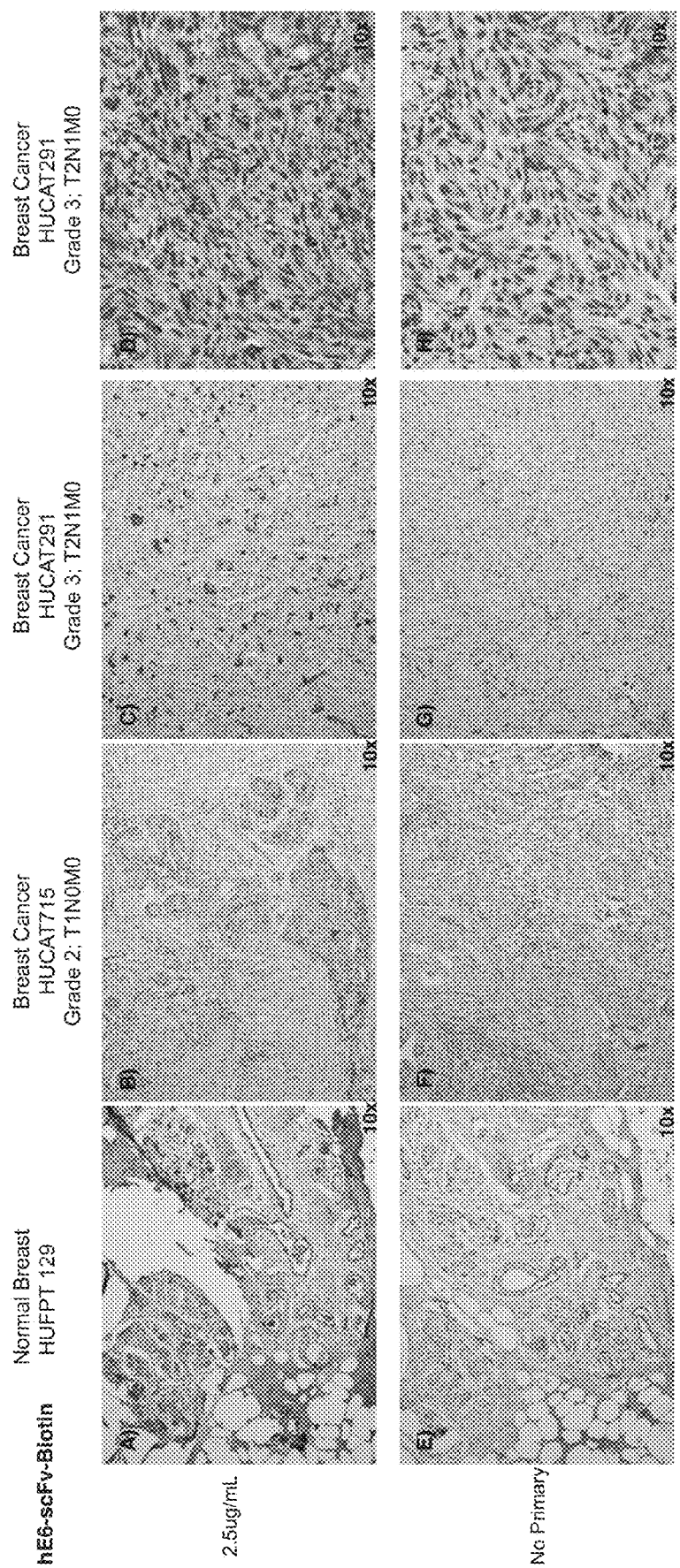

FIG. 45 shows photographs of normal breast and breast cancer tissues stained with humanized MN-E6-scFv-Fc biotinylated anti-MUC1* antibody at 2.5 ug/mL, then stained with a secondary streptavidin HRP antibody. A) is a normal breast tissue. B-D are breast cancer tissues from patients as denoted in the figure. E-H are photographs of the corresponding serial sections that were stained with the secondary antibody alone.

Figure 46:
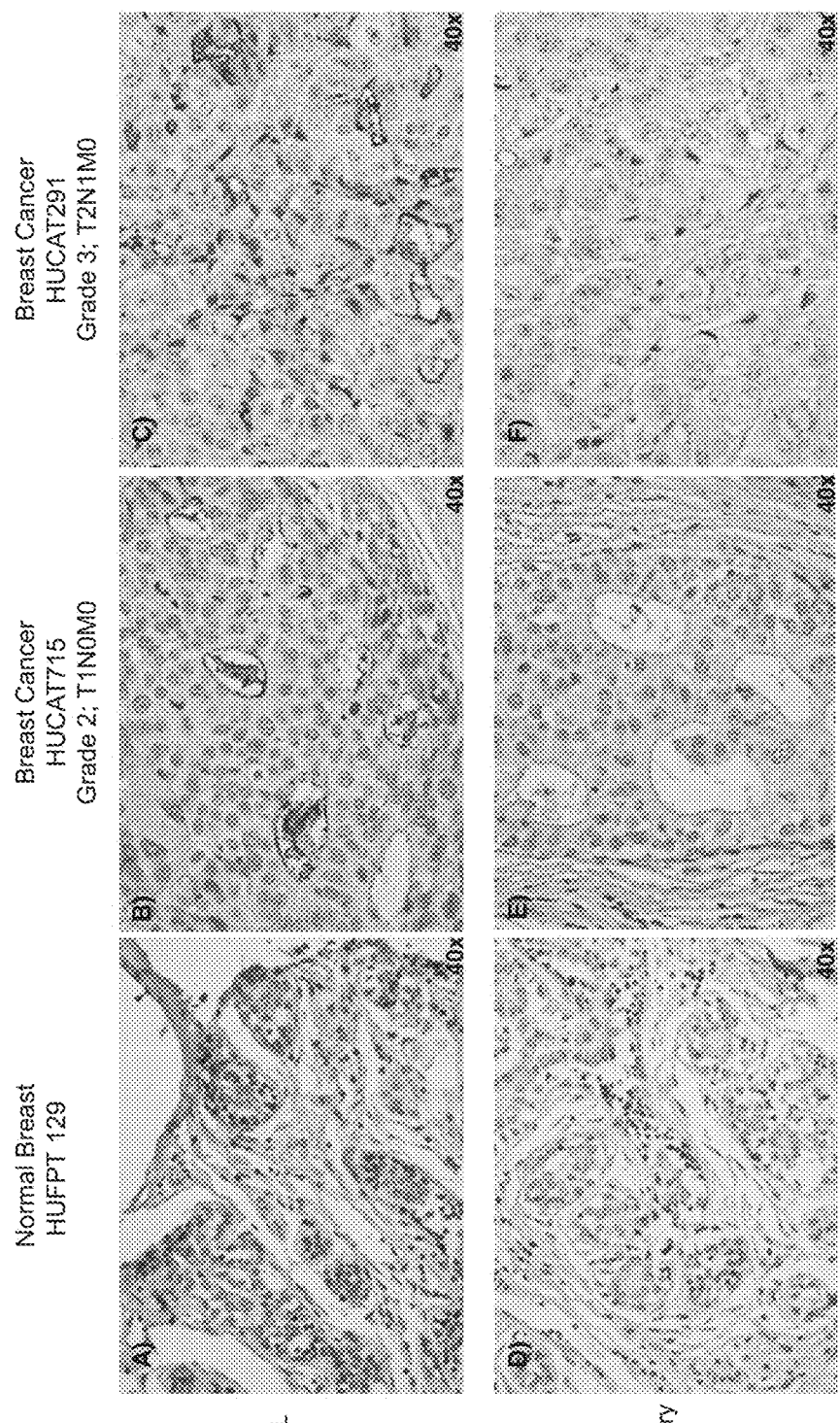

FIG. 46 shows photographs of normal breast and breast cancer tissues stained with humanized MN-E6-scFv-Fc biotinylated anti-MUC1* antibody at 2.5 ug/mL, then stained with a secondary streptavidin HRP antibody. A) is a normal breast tissue. B-C are breast cancer tissues from patients as denoted in the figure. D-F are photographs of the corresponding serial sections that were stained with the secondary antibody alone.

Figure 47:
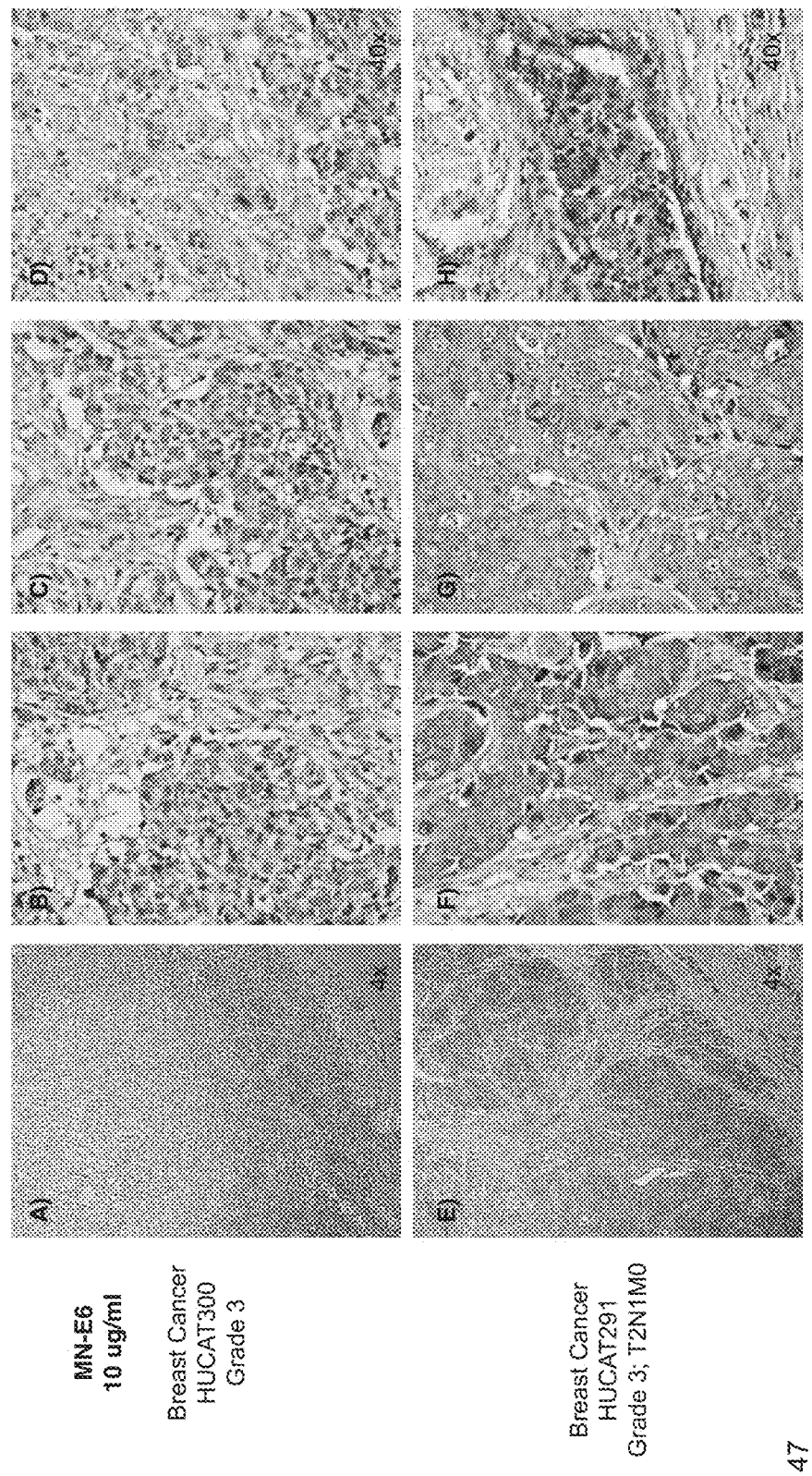

FIG. 47 shows photographs of breast cancer tissues stained with MN-E6 anti-MUC1* antibody at 10 ug/mL, then stained with a rabbit anti mouse secondary HRP antibody. A-D are breast cancer tissues from patient #300. E-H are breast cancer tissues from metastatic patient #291.

Figure 48:
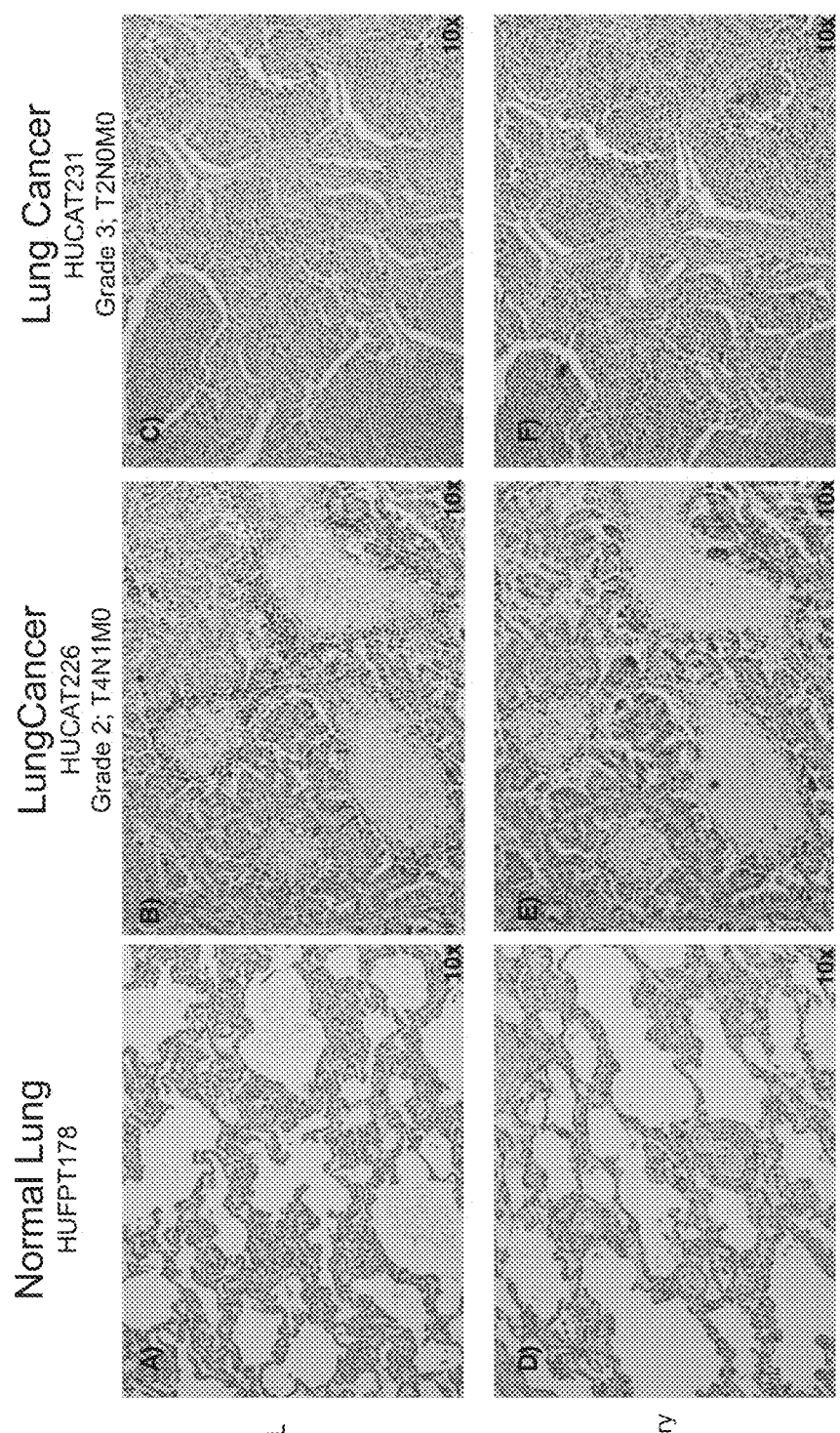

FIG. 48 shows photographs of normal lung and lung cancer tissues stained with humanized MN-E6-scFv-Fc biotinylated anti-MUC1* antibody at 2.5 ug/mL, then stained with a secondary streptavidin HRP antibody. A) is a normal lung tissue. B,C are lung cancer tissues from patients as denoted in the figure. D-F are photographs of the corresponding serial sections that were stained with the secondary antibody alone.

Figure 49:
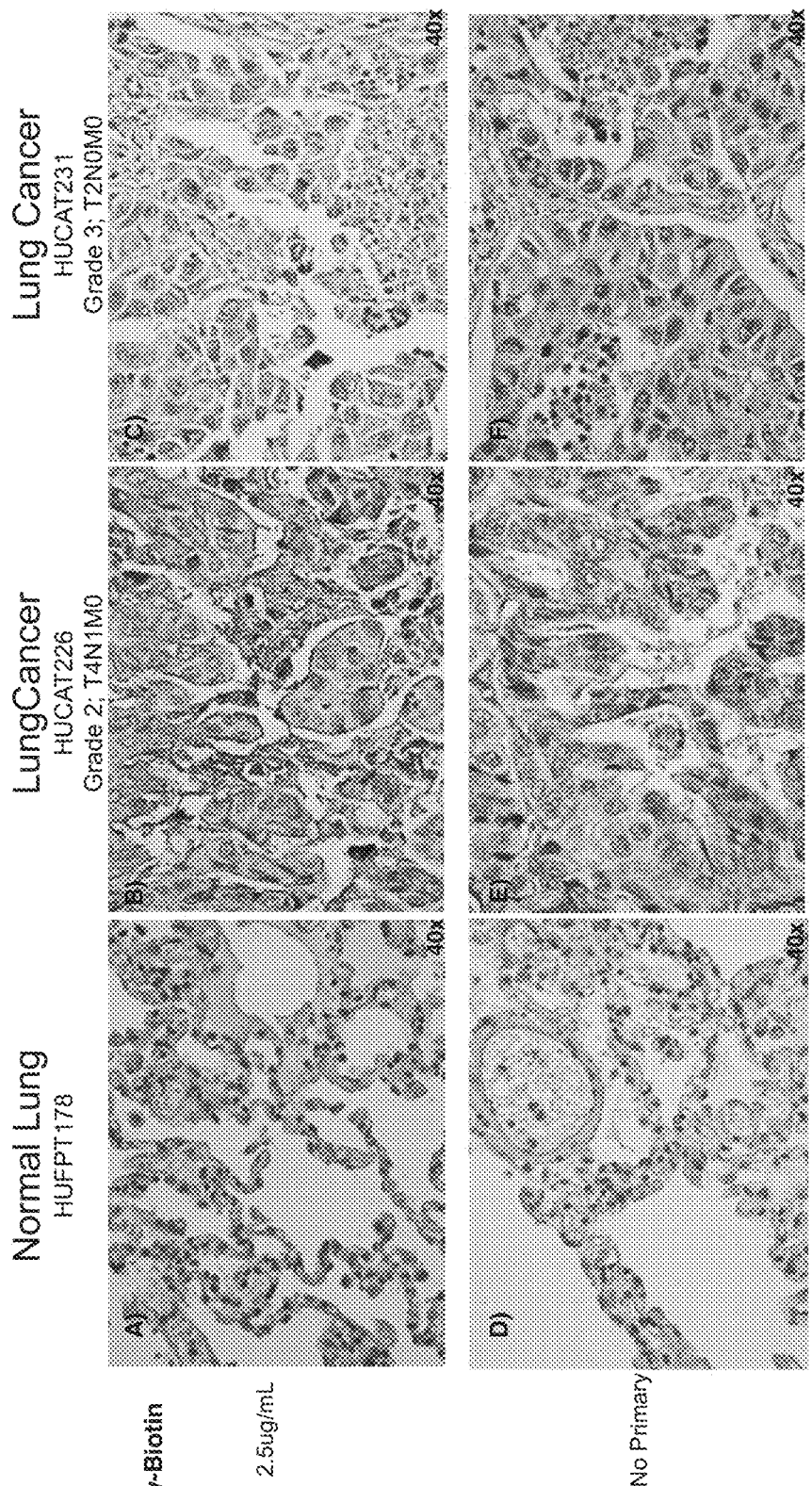

FIG. 49 shows photographs of normal lung and lung cancer tissues stained with humanized MN-E6-scFv-Fc biotinylated anti-MUC1* antibody at 2.5 ug/mL, then stained with a secondary streptavidin HRP antibody. A) is a normal lung tissue. B,C are lung cancer tissues from patients as denoted in the figure. D-F are photographs of the corresponding serial sections that were stained with the secondary antibody alone.

Figure 50:
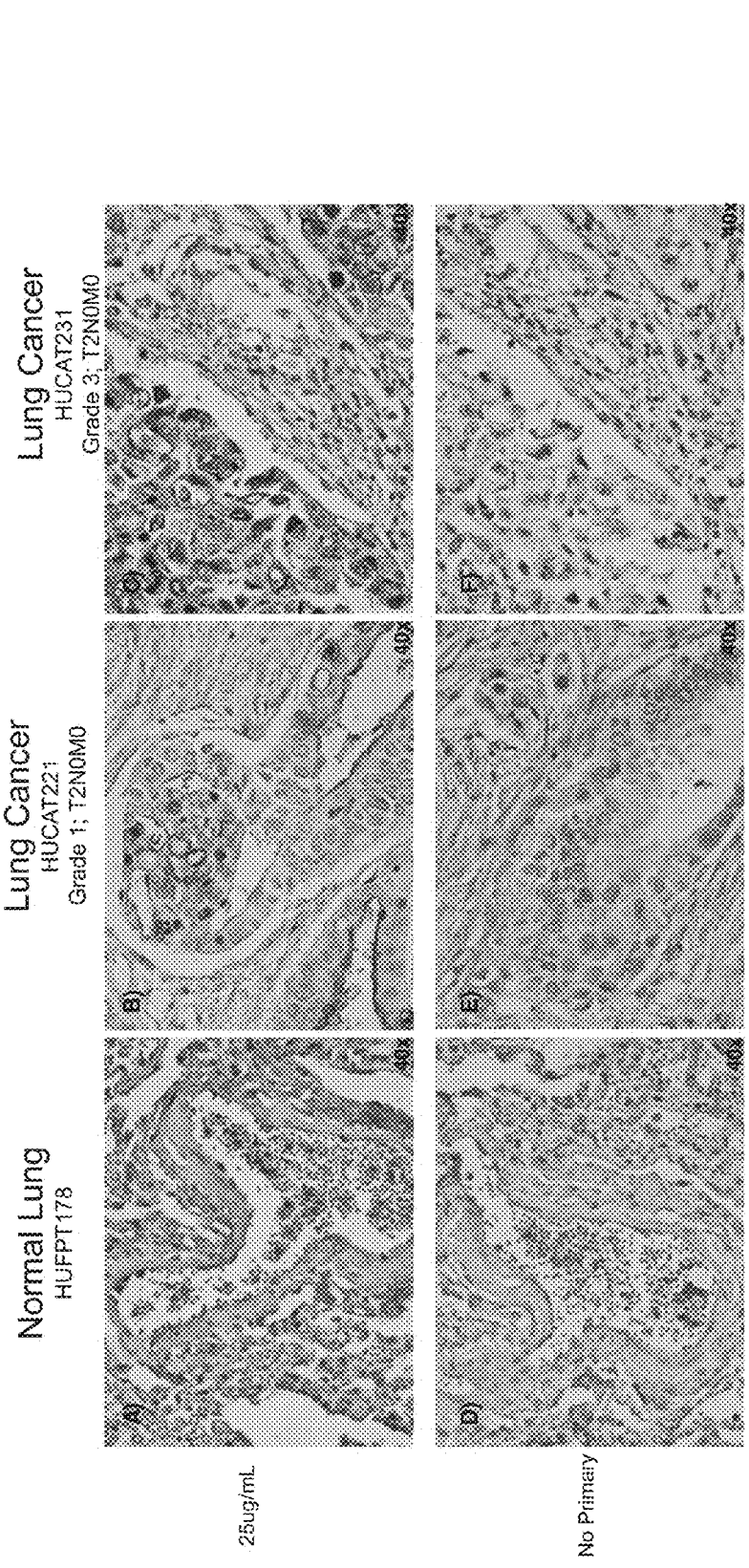

FIG. 50 shows photographs of normal lung and lung cancer tissues stained with humanized MN-E6-scFv-Fc biotinylated anti-MUC1* antibody at 25 ug/mL, then stained with a secondary streptavidin HRP antibody. A) is a normal lung tissue. B,C are lung cancer tissues from patients as denoted in the figure. D-F are photographs of the corresponding serial sections that were stained with the secondary antibody alone.

Figure 51:
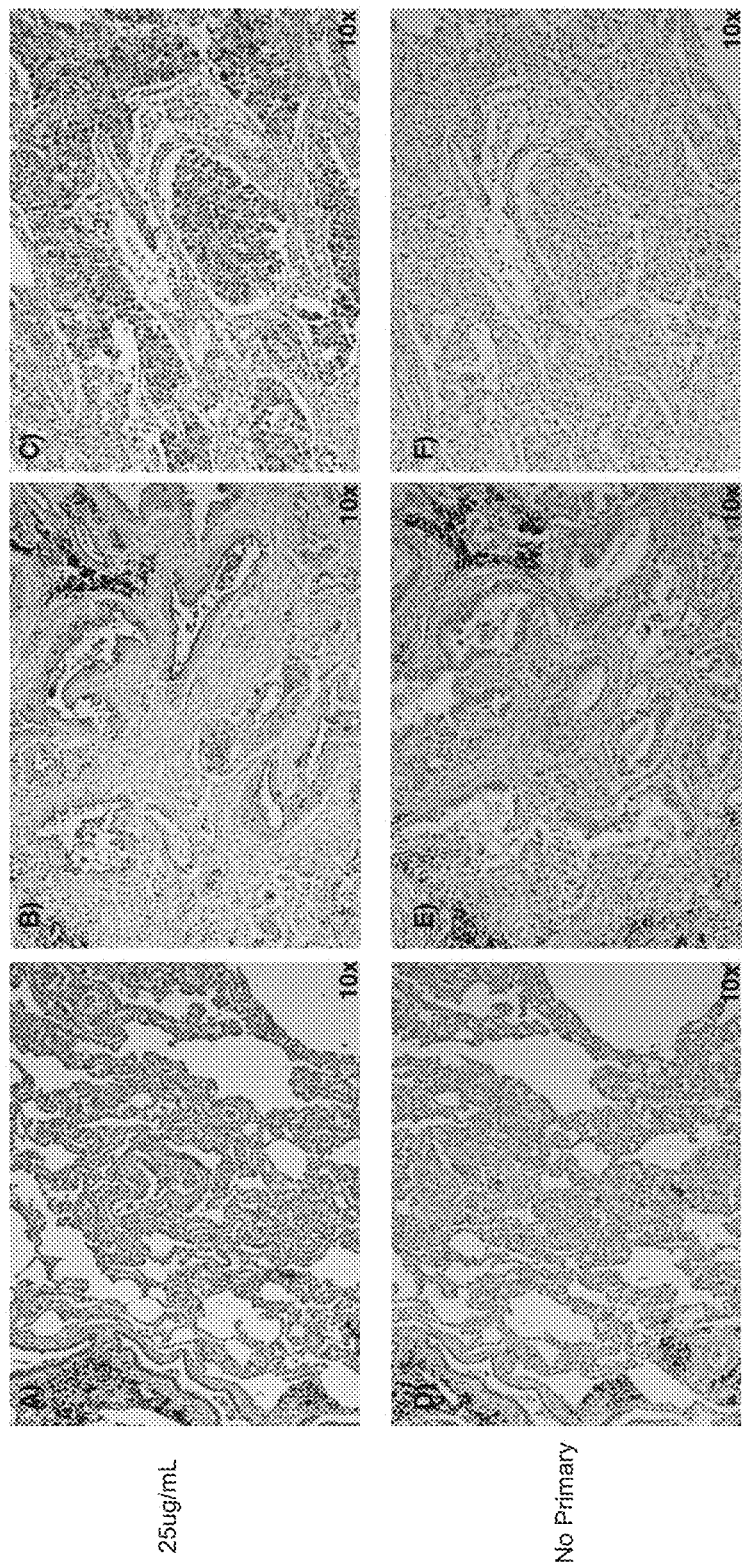

FIG. 51 shows photographs of normal lung and lung cancer tissues stained with humanized MN-E6-scFv-Fc biotinylated anti-MUC1* antibody at 25 ug/mL, then stained with a secondary streptavidin HRP antibody. A) is a normal lung tissue. B,C are lung cancer tissues from patients as denoted in the figure. D-F are photographs of the corresponding serial sections that were stained with the secondary antibody alone.

Figure 52:
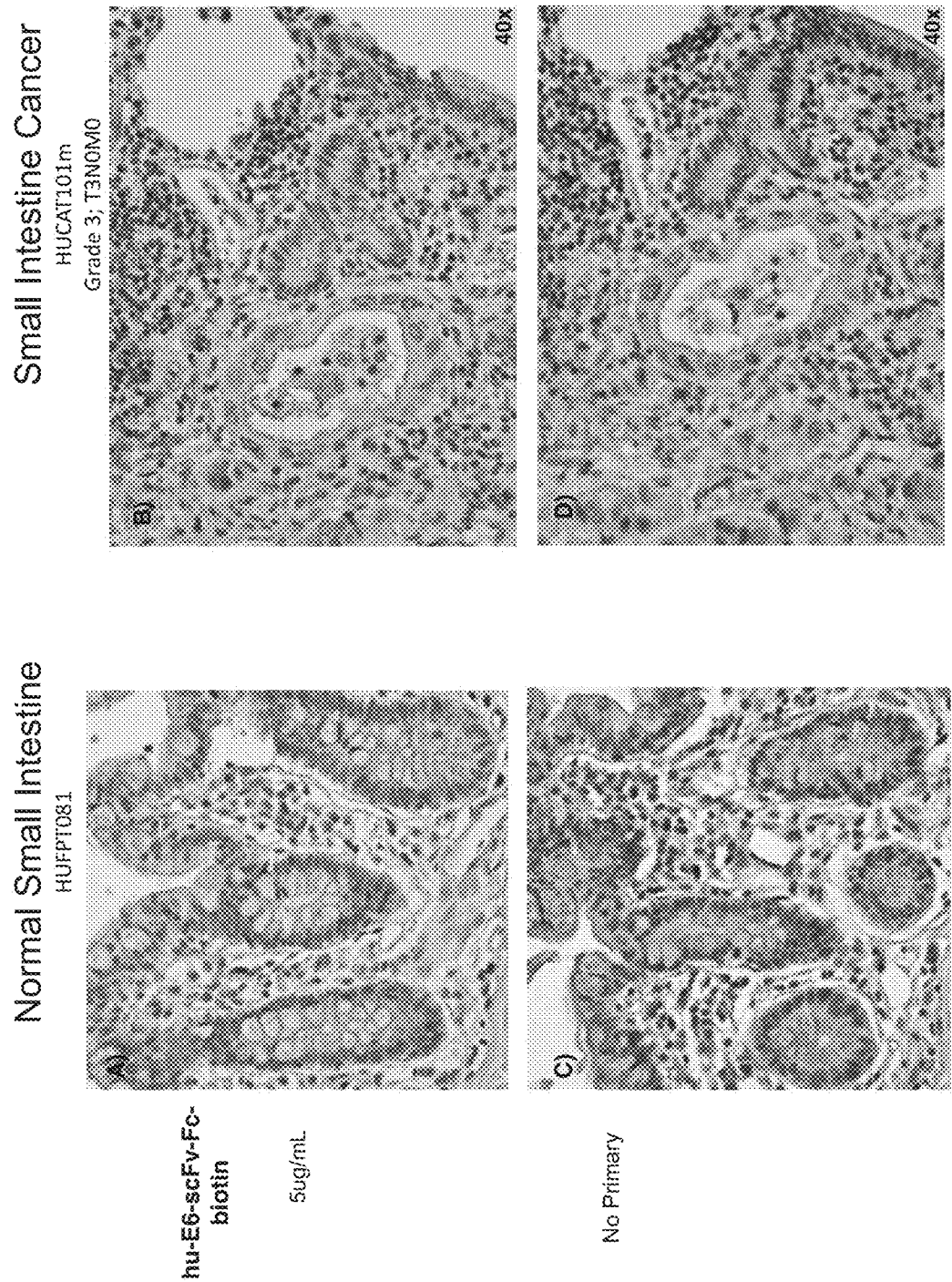

FIG. 52 shows photographs of normal small intestine and cancerous small intestine tissues stained with humanized MN-E6-scFv-Fc biotinylated anti-MUC1* antibody at 5 ug/mL, then stained with a secondary streptavidin HRP antibody. A) is a normal small intestine tissue. B) is small intestine cancer from patient as denoted in the figure. C,D are photographs of the corresponding serial sections that were stained with the secondary antibody alone.

Figure 53:
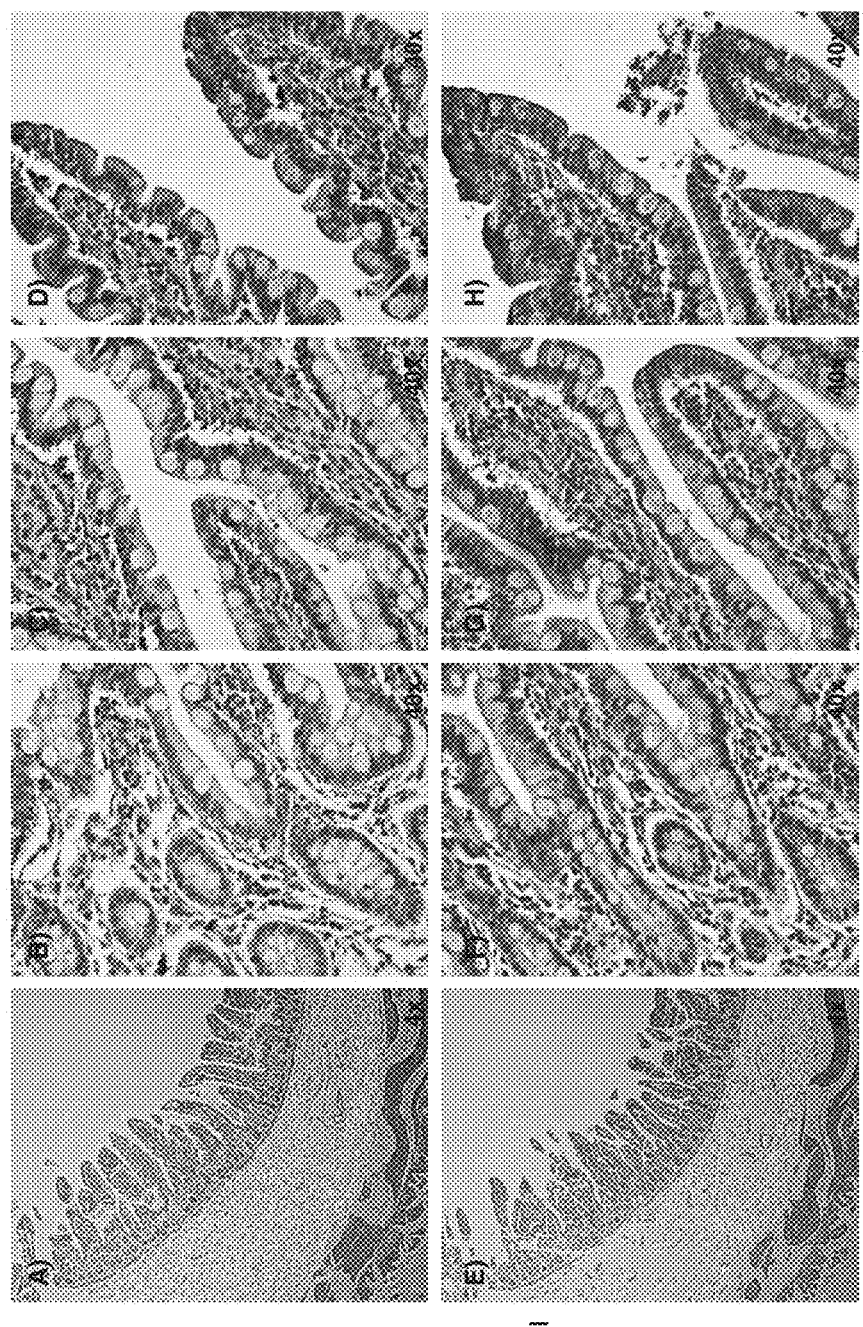

FIG. 53 shows photographs of normal small intestine tissues stained with humanized MN-E6-scFv-Fc anti-MUC1* antibody at 50 ug/mL, then stained with a secondary goat-anti-human HRP antibody. A-D are normal small intestine tissue. E-H are photographs of the corresponding serial sections that were stained with the secondary antibody alone.

Figure 54:
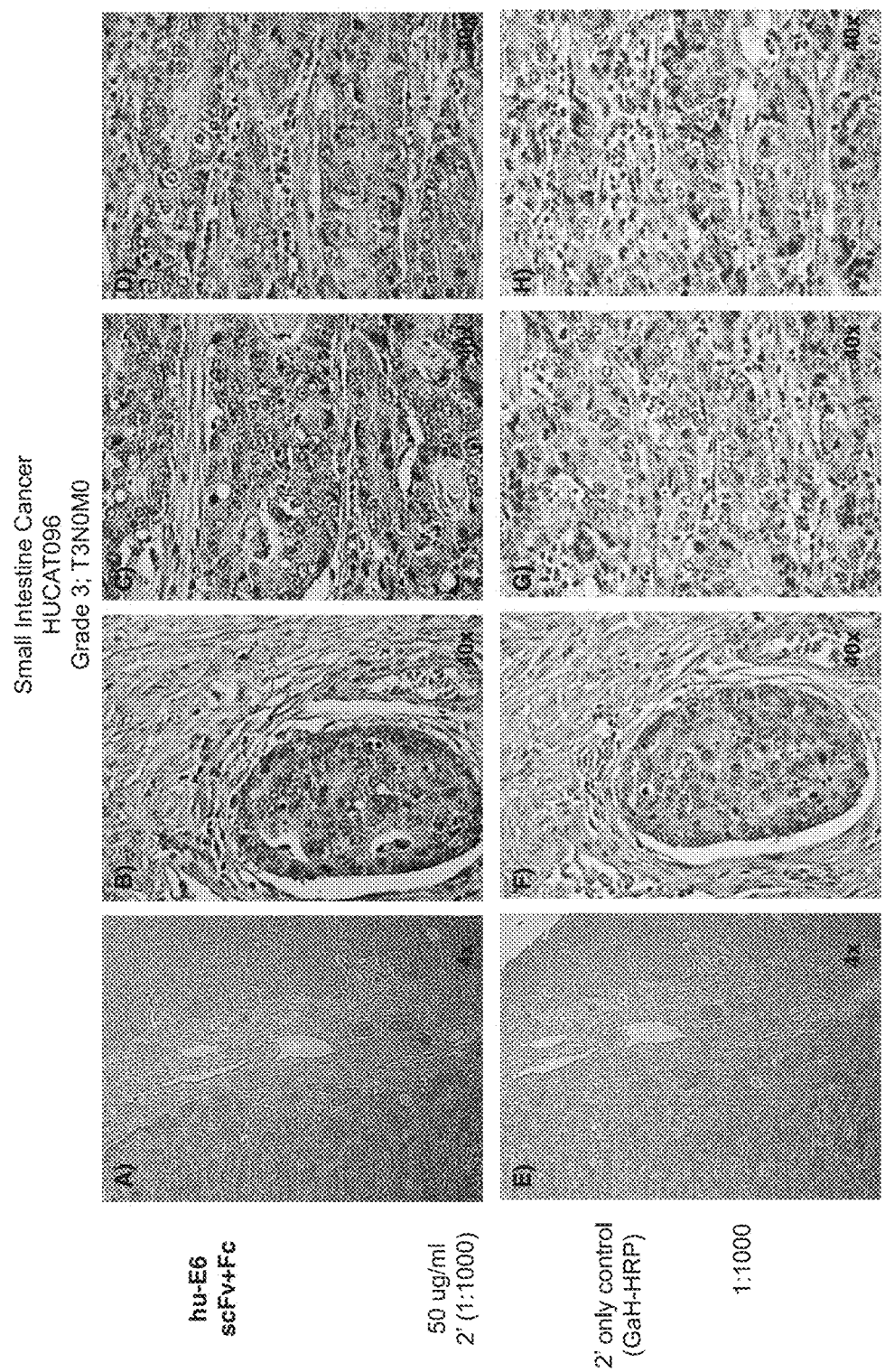

FIG. 54 shows photographs of cancerous small intestine tissues stained with humanized MN-E6-scFv-Fc anti-MUC1* antibody at 50 ug/mL, then stained with a secondary goat-anti-human HRP antibody. A-D are cancerous small intestine tissue from a patient as denoted in figure. E-H are photographs of the corresponding serial sections that were stained with the secondary antibody alone.

Figure 55:
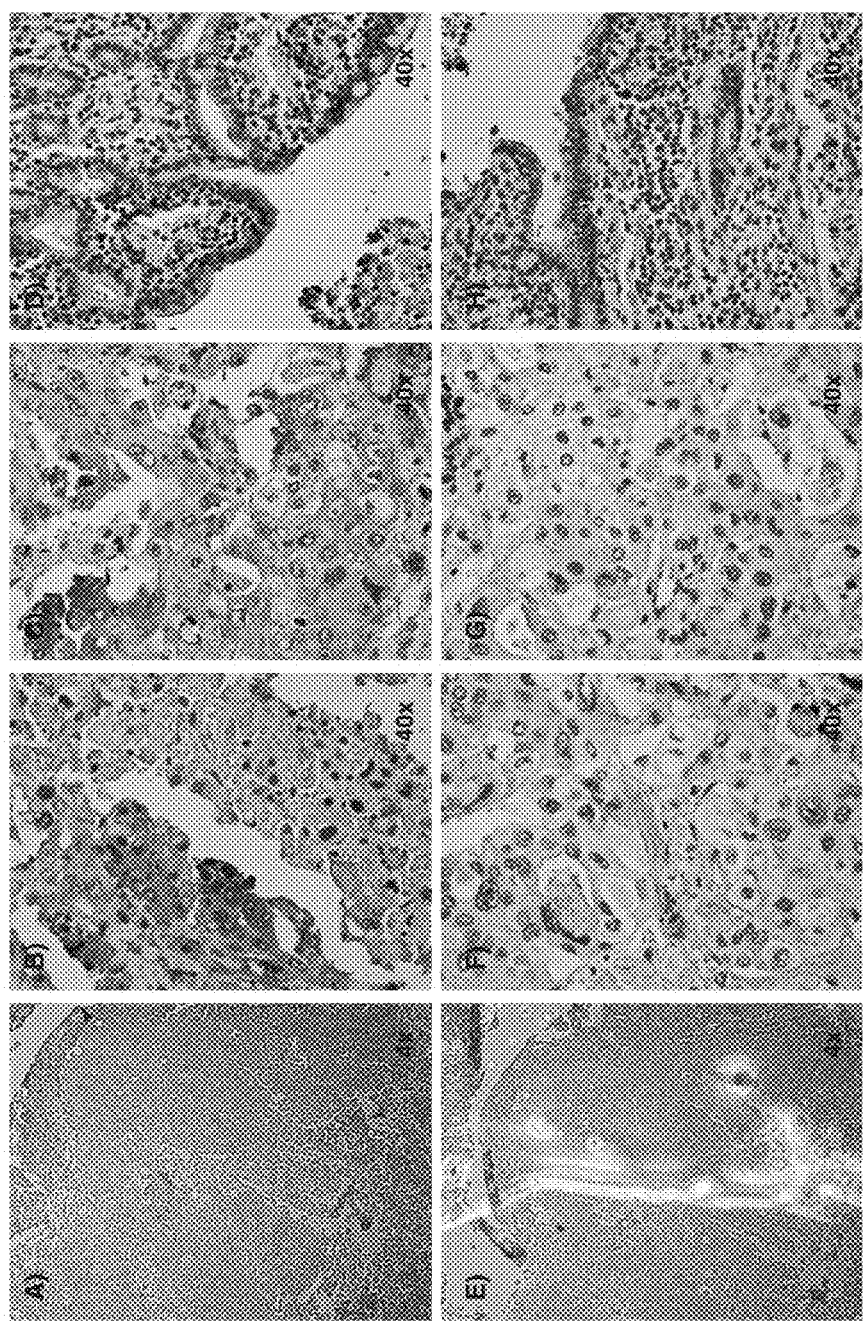

FIG. 55 shows photographs of cancerous small intestine tissues stained with humanized MN-E6-scFv-Fc anti-MUC1* antibody at 50 ug/mL, then stained with a secondary goat-anti-human HRP antibody. A-D are cancerous small intestine tissue from a patient as denoted in figure. E-H are photographs of the corresponding serial sections that were stained with the secondary antibody alone.

Figure 56:
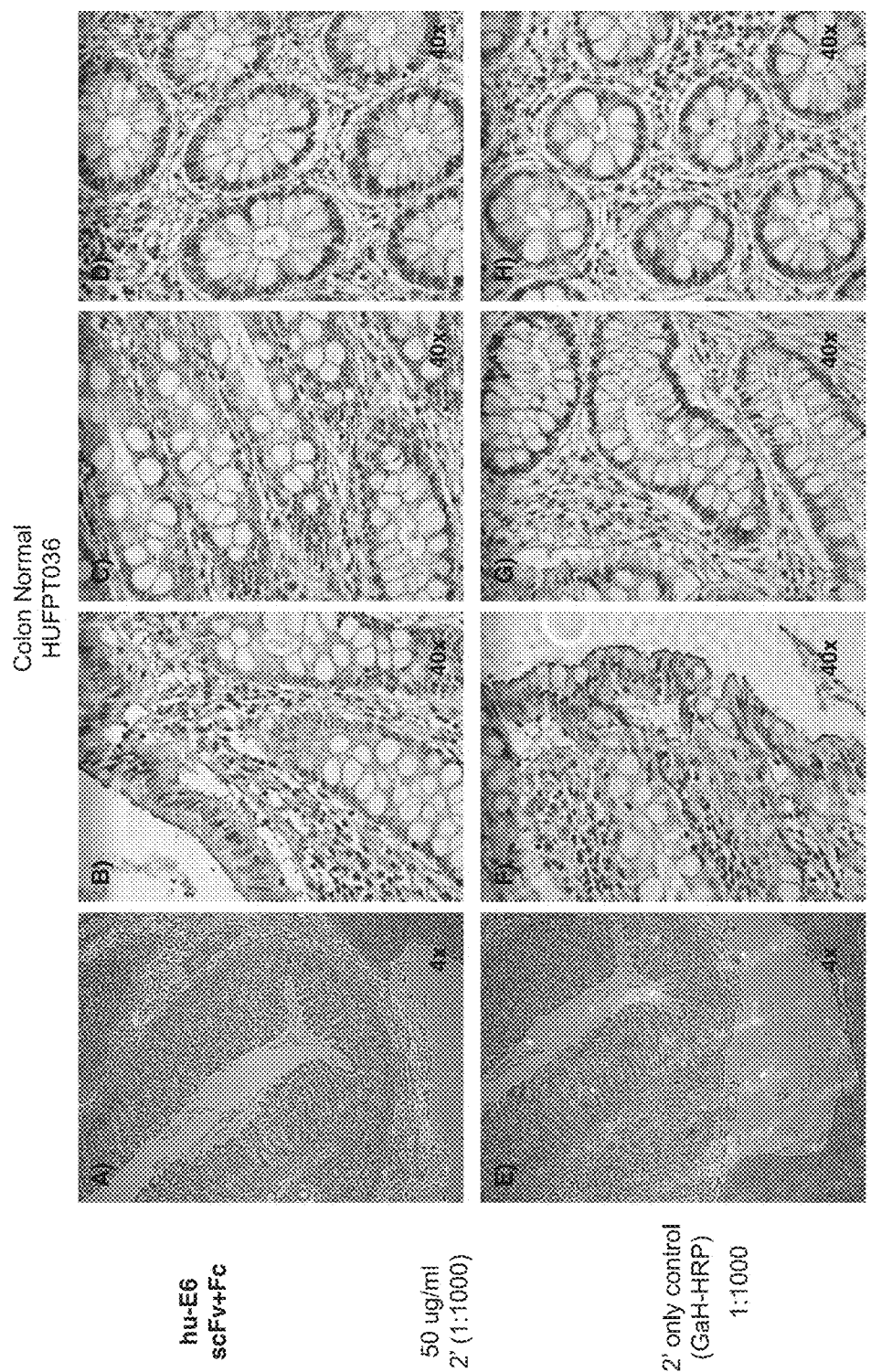

FIG. 56 shows photographs of normal colon tissues stained with humanized MN-E6-scFv-Fc anti-MUC1* antibody at 50 ug/mL, then stained with a secondary goat-anti-human HRP antibody. A-D are normal colon. E-H are photographs of the corresponding serial sections that were stained with the secondary antibody alone.

Figure 57:
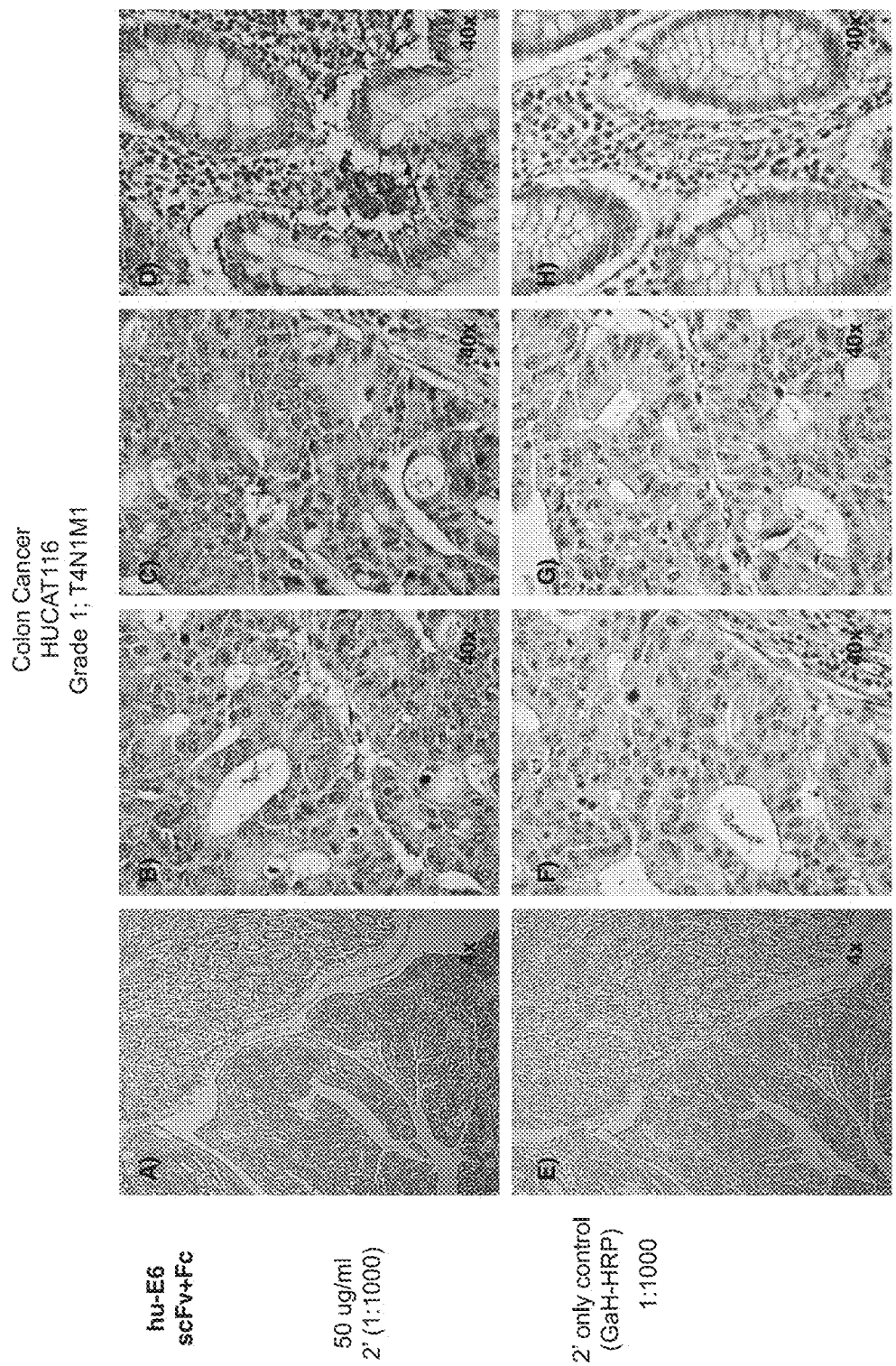

FIG. 57 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a metastatic patient as denoted in figure. E-H are photographs of the corresponding serial sections that were stained with the secondary antibody alone.

Figure 58:
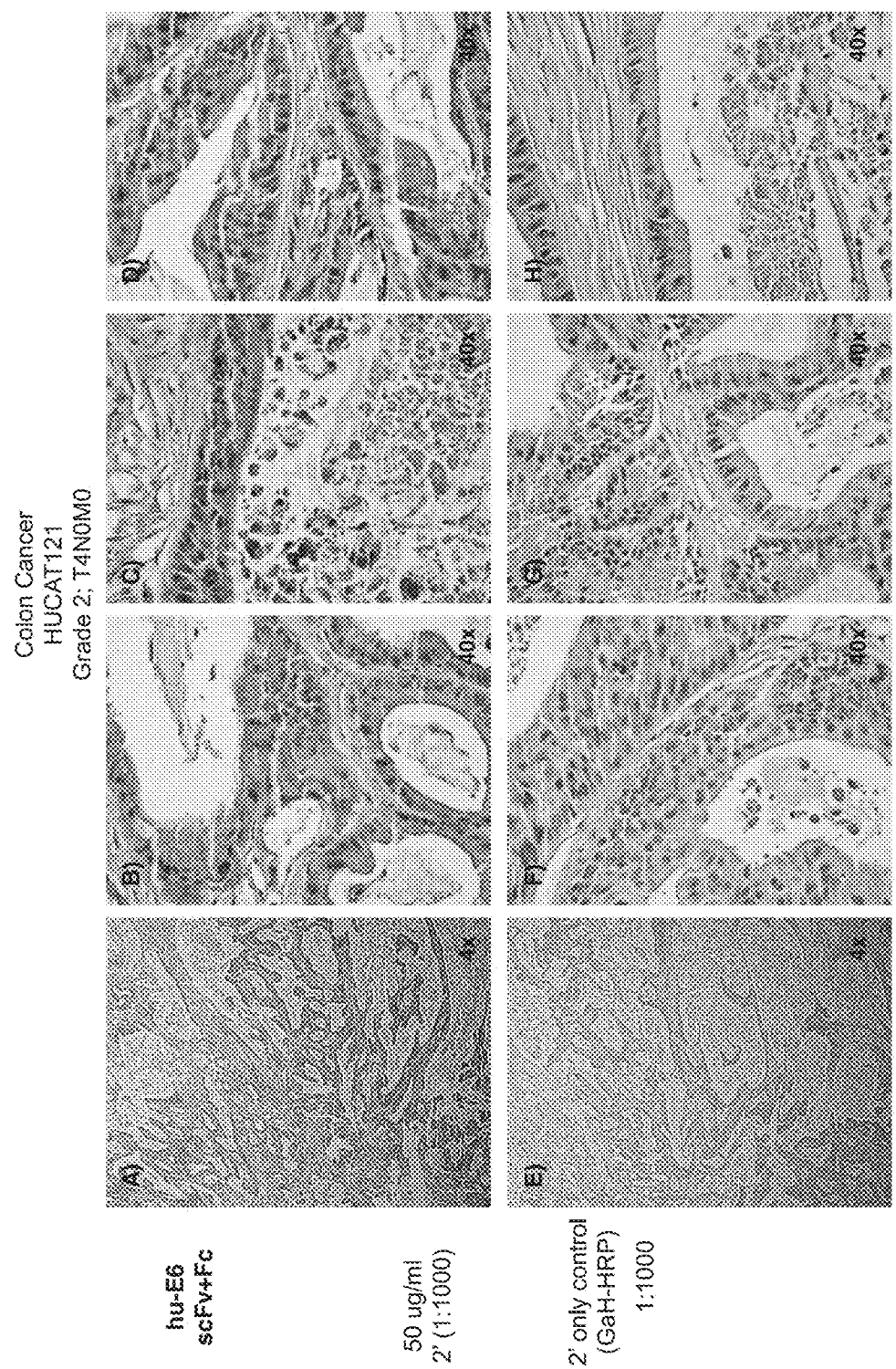

FIG. 58 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a Grade 2 patient as denoted in figure. E-H are photographs of the corresponding serial sections that were stained with the secondary antibody alone.

Figure 59:
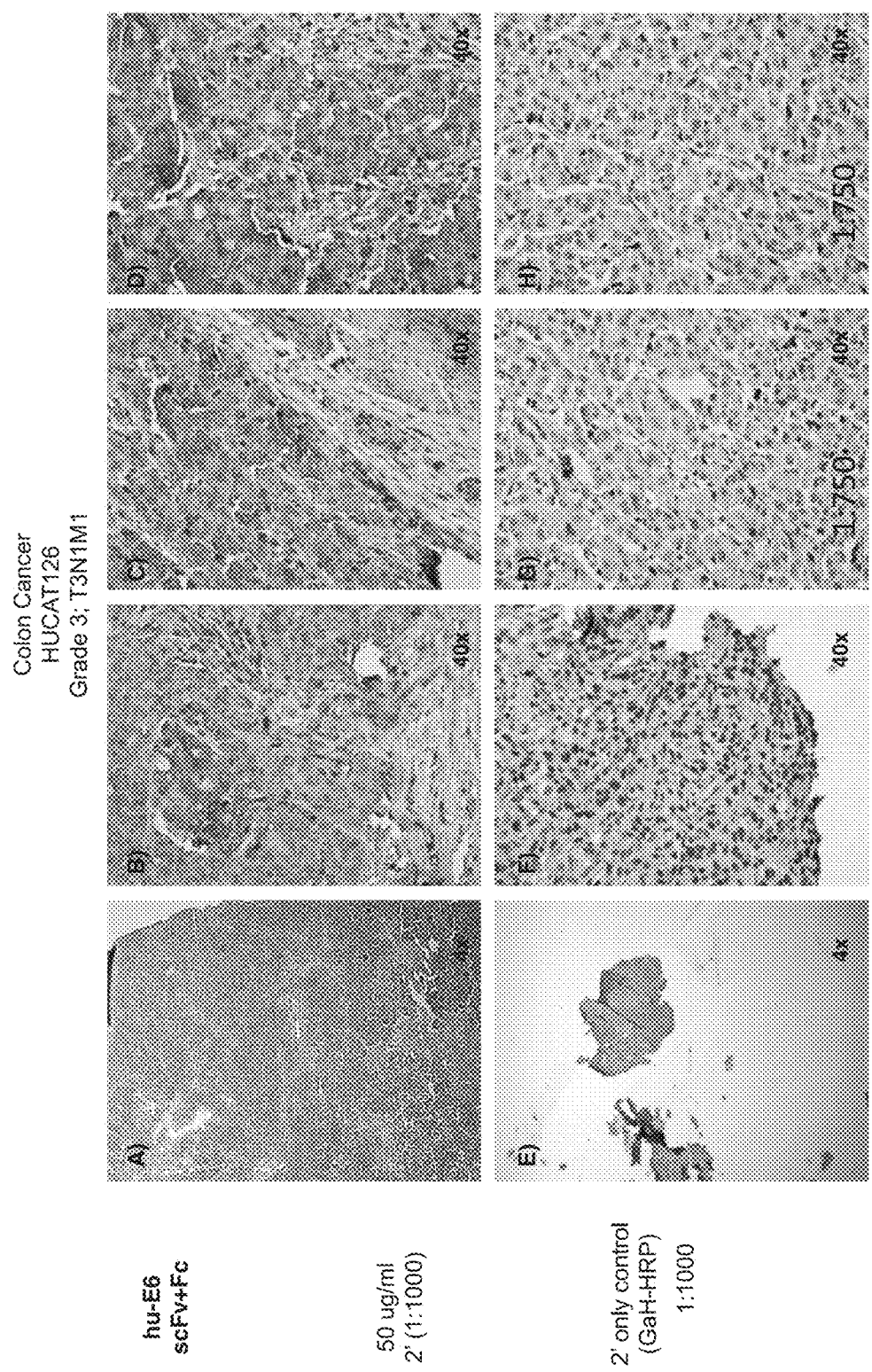

FIG. 59 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a metastatic patient as denoted in figure. E-H are photographs of the corresponding serial sections that were stained with the secondary antibody alone.

Figure 60:
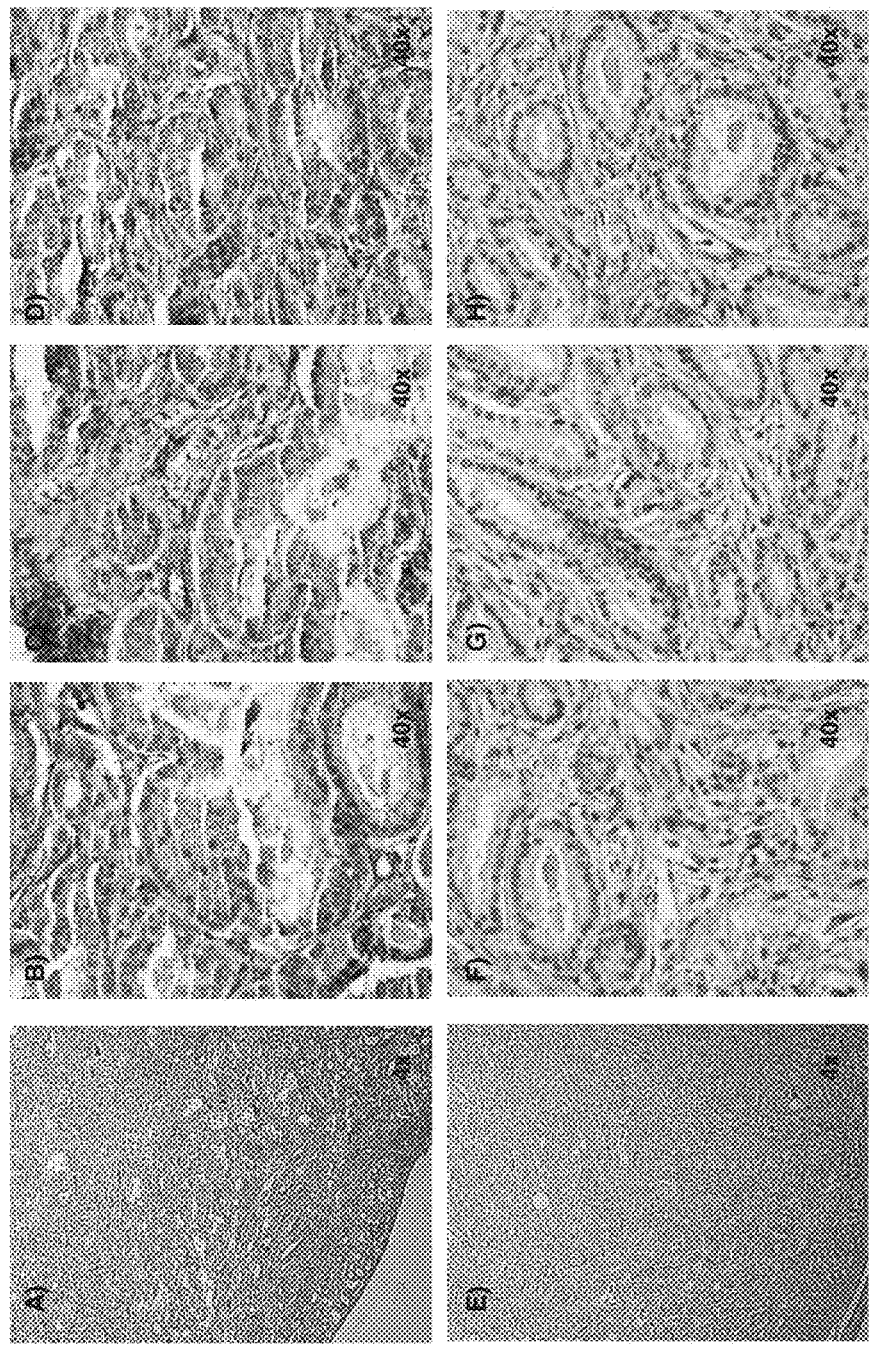

FIG. 60 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone.

Figure 61:
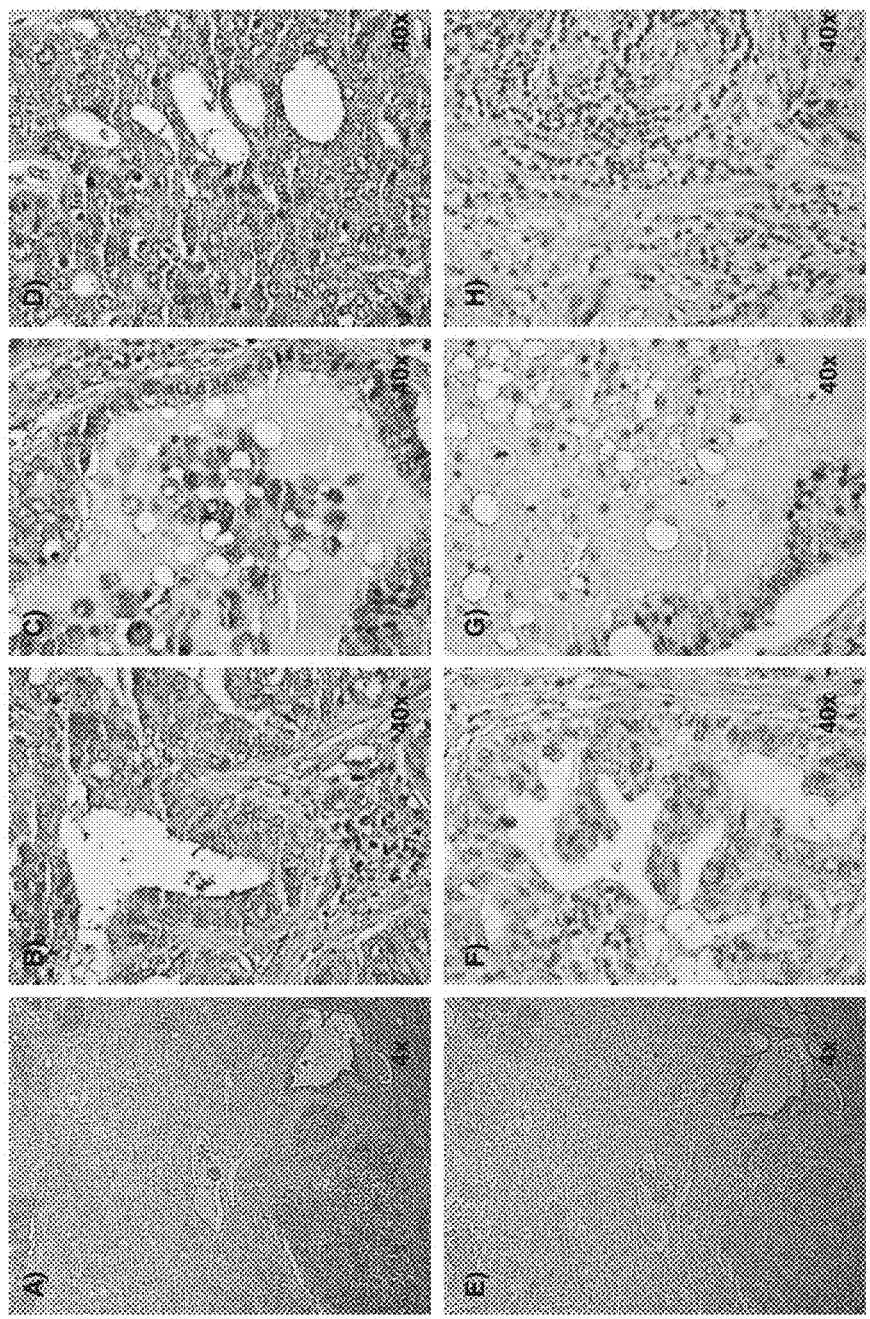

FIG. 61 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone.

Figure 62:
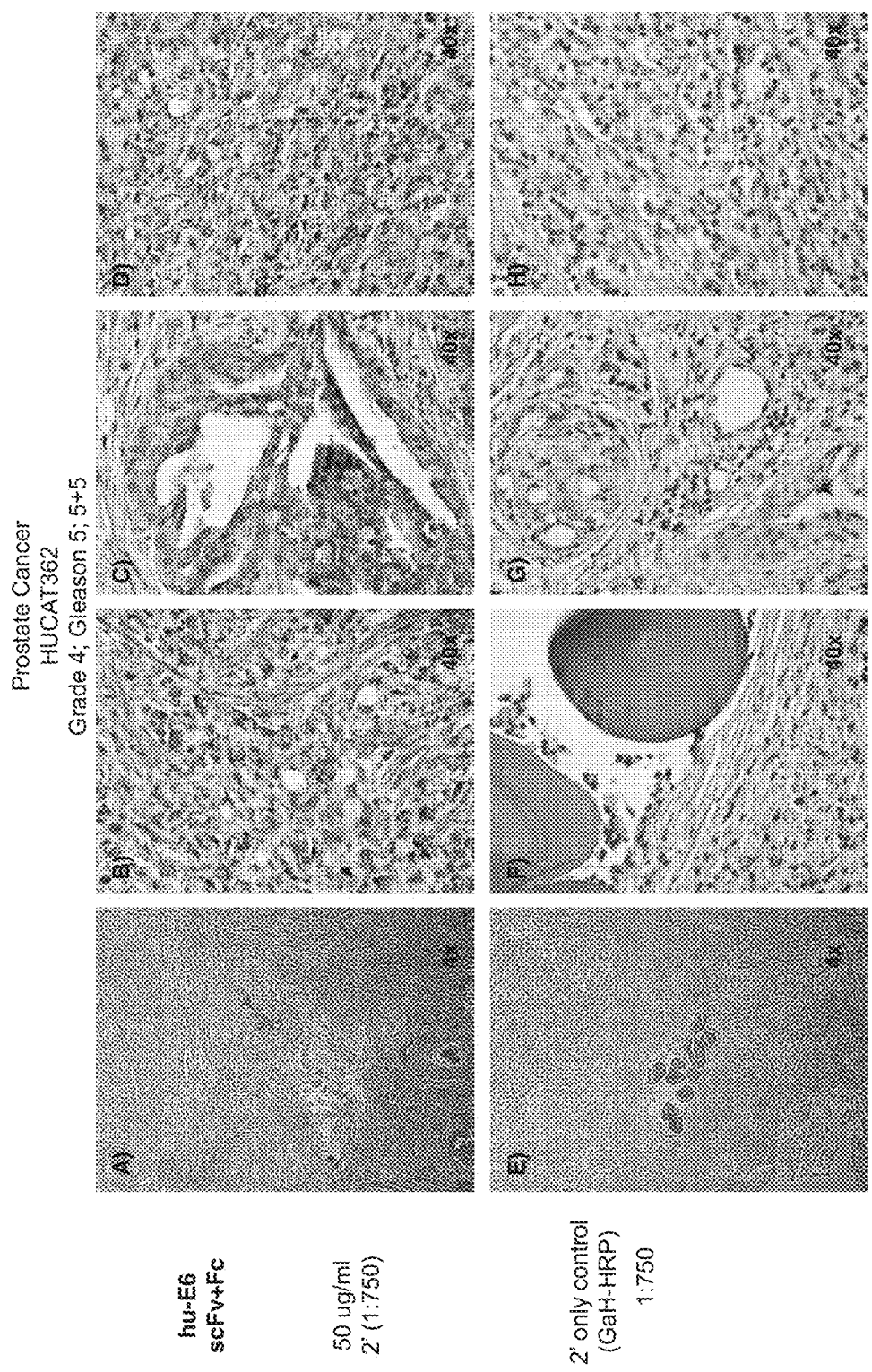

FIG. 62 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone.

DETAILED DESCRIPTION OF THE PREFERRED EMBODIMENTS

In the present application, "a" and "an" are used to refer to both single and a plurality of objects.

As used herein, "h" or "hu" placed before an antibody construct is short-hand for humanized.

As used herein, the term "antibody-like" means a molecule that may be engineered such that it contains portions of antibodies but is not an antibody that would naturally occur in nature. Examples include but are not limited to CAR (chimeric antigen receptor) T cell technology and the Ylanthia® technology. The CAR technology uses an antibody epitope fused to a portion of a T cell so that the body's immune system is directed to attack a specific target protein or cell. The Ylanthia® technology consists of an "antibody-like" library that is a collection of synthetic human Fabs that are then screened for binding to peptide epitopes from target proteins. The selected Fab regions can then be engineered into a scaffold or framework so that they resemble antibodies.

As used herein, the antibodies MN-C2, MN-E6, MN-C3 and MN-C8, may also be referred to as C2, E6, C3 and C8, respectively.

As used herein, "PSMGFR" is abbreviation for Primary Sequence of the MUC1 Growth Factor Receptor which is identified by SEQ ID NO:2, and thus is not to be confused with a six amino acid sequence. "PSMGFR peptide" or "PSMGFR region" refers to a peptide or region that incorporates the Primary Sequence of the MUC1 Growth Factor Receptor (SEQ ID NO:2).

As used herein, the "MUC1*" extra cellular domain is defined primarily by the PSMGFR sequence (GTINVHDVETQFNQYKTEAAS-RYNLTISDVSVSDVPFPFSAQSGA (SEQ ID NO:2)).

Because the exact site of MUC1 cleavage depends on the enzyme that clips it, and that the cleavage enzyme varies depending on cell type, tissue type or the time in the evolution of the cell, the exact sequence of the MUC1* extra cellular domain may vary at the N-terminus.

Other clipped amino acid sequences may include SNIKFRPGSVVVQLTLAFREGTINVHDVETQFNQYK-TEAASRY (SEQ ID NO:620); or SVVVQLTLAFREGT-INVHDVETQFNQYKTEAASRY (SEQ ID NO:621).

As used herein, the term "PSMGFR" is an acronym for Primary Sequence of MUC1 Growth Factor Receptor as set forth as GTINVHDVETQFNQYKTEAAS-RYNLTISDVSVSDVPFPFSAQSGA (SEQ ID NO:2). In this regard, the "N-number" as in "N-10 PSMGFR", "N-15 PSMGFR", or "N-20 PSMGFR" refers to the number of amino acid residues that have been deleted at the N-terminal end of PSMGFR. Likewise "C-number" as in "C-10 PSMGFR", "C-15 PSMGFR", or "C-20 PSMGFR" refers to the number of amino acid residues that have been deleted at the C-terminal end of PSMGFR.

As used herein, the "extracellular domain of MUC1*" refers to the extracellular portion of a MUC1 protein that is devoid of the tandem repeat domain. In most cases, MUC1* is a cleavage product wherein the MUC1* portion consists of a short extracellular domain devoid of tandem repeats, a transmembrane domain and a cytoplasmic tail. The precise location of cleavage of MUC1 is not known perhaps because it appears that it can be cleaved by more than one enzyme. The extracellular domain of MUC1* will include most of the PSMGFR sequence but may have an additional 10-20 N-terminal amino acids.

As used herein "sequence identity" means homology in sequence of a particular polypeptide or nucleic acid to a reference sequence of nucleic acid or amino acid such that the function of the homologous peptide is the same as the reference peptide or nucleic acid. Such homology can be so close with the reference peptide such that at times the two sequences may be 90%, 95% or 98% identical yet possess the same function in binding or other biological activities.

MUC1* antibodies (anti-PSMGFR) for treatment or prevention of cancers

We discovered that a cleaved form of the MUC1 (SEQ ID NO:1) transmembrane protein is a growth factor receptor that drives the growth of over 75% of all human cancers. The cleaved form of MUC1, which we called MUC1* (pronounced muk 1 star), is a powerful growth factor receptor. Enzymatic cleavage releases the bulk of the MUC1 extracellular domain. It is the remaining portion comprising a truncated extracellular domain, transmembrane and cytoplasmic tail that is called MUC1*. Cleavage and release of the bulk of the extracellular domain of MUC1 unmasks a binding site for activating ligands dimeric NME1, NME6, NME8, NME7-AB or NME7. Cell growth assays show that it is ligand-induced dimerization of the MUC1* extracellular domain that promotes growth (FIG. 1A-D). MUC1* positive cells treated with either bivalent 'by' anti-MUC1* antibody, monovalent 'my' or Fab, NM23-H1 dimers or NME7-AB. Bivalent anti-MUC1* antibodies stimulate growth of cancer cells whereas the monovalent Fab inhibits growth. Classic bell-shaped curve indicates ligand induced dimerization stimulates growth. Dimeric NM23-H1, aka NME1, stimulates growth of MUC1* positive cancer cells but siRNA to suppress MUC1 expression eliminate its effect (C). NME7-AB also stimulates the growth of MUC1* positive cells (D).

Figure 1:
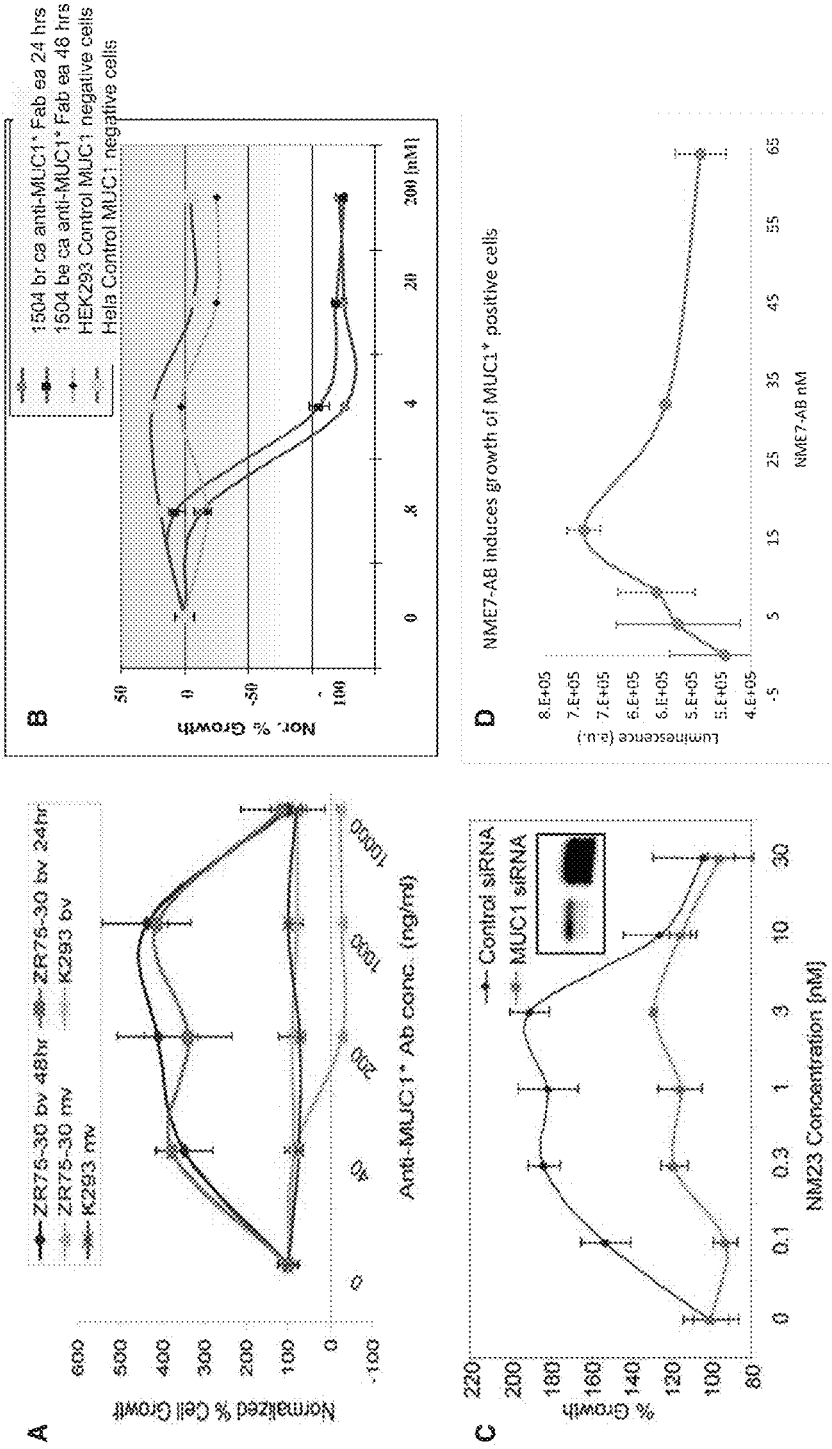
FIG. 1A-D show cell growth assay graphs of MUC1* positive cells treated with either bivalent 'by' anti-MUC1* antibody, monovalent 'my' or Fab, NM23-H1 dimers or NME7-AB. Bivalent anti-MUC1* antibodies stimulate growth of cancer cells whereas the monovalent Fab inhibits growth (A, B). Classic bell-shaped curve indicates ligand induced dimerization stimulates growth. Dimeric NM23-H1, aka NME1, stimulates growth of MUC1* positive cancer cells but siRNA to suppress MUC1 expression eliminate its effect (C). NME7-AB also stimulates the growth of MUC1* positive cells (D).
Figure 2:
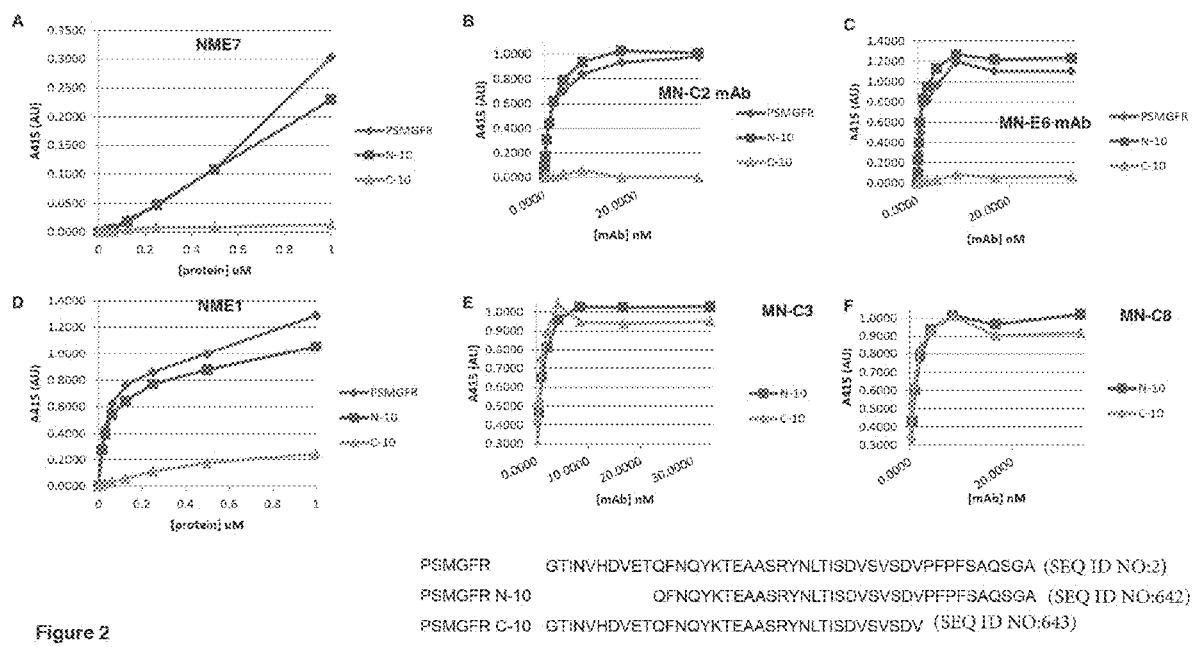
FIG. 2A-F show results of ELISA assays. MUC1* peptides PSMGFR, PSMGFR minus 10 amino acids from the N-terminus aka N-10, or PSMGFR minus 10 amino acids from the C-terminus, aka C-10 are immobilized on the plate and the following are assayed for binding: NME7-AB (A), MN-C2 monoclonal antibody (B), MN-E6 monoclonal antibody (C), or dimeric NME1 (D). These assays show that NME1, NME7-AB and monoclonal antibodies MN-C2 and MN-E6 all require the first membrane proximal 10 amino acids of the MUC1* extracellular domain to bind. MUC1* peptides PSMGFR minus 10 amino acids from the N-terminus aka N-10, or PSMGFR minus 10 amino acids from the C-terminus, aka C-10, are immobilized on the plate and the following are assayed for binding: MN-C3 (E) and MN-C8 (F).

MUC1* is an ideal target for cancer drugs as it is aberrantly expressed on over 75% of all cancers and is likely overexpressed on an even higher percentage of metastatic cancers (Fessler S P, Wotkowicz M T, Mahanta S K and Bamdad C. (2009). MUC1* is a determinant of trastuzumab (Herceptin) resistance in breast cancer cells. Breast Cancer Res Treat. 118(1):113-124). After MUC1 cleavage most of its extracellular domain is shed from the cell surface. The remaining portion has a truncated extracellular domain that at least comprises the primary growth factor receptor sequence, PSMGFR (SEQ ID NO:2). Antibodies that bind to the PSMGFR sequence and especially those that competitively inhibit the binding of activating ligands such as NME proteins, including NME1, NME6, NME8 and NME7, are ideal therapeutics and can be used to treat or prevent MUC1 positive or MUC1* positive cancers, as stand-alone antibodies, antibody fragments or variable region fragments thereof incorporated into bispecific antibodies, or chimeric antigen receptors also called CARs. Therapeutics anti-MUC1* antibodies can be monoclonal, polyclonal, antibody mimics, engineered antibody-like molecules, full antibodies or antibody fragments. Examples of antibody fragments include but are not limited to Fabs, scFv, and scFv-Fc. Human or humanized antibodies are preferred for use in the treatment or prevention of cancers. In any of these antibody-like molecules, mutations can be introduced to prevent or minimize dimer formation. Anti-MUC1* antibodies that are monovalent or bispecific are preferred because MUC1* function is activated by ligand induced dimerization. Typical binding assays show that NME1 and NME7 bind to the PSMGFR peptide portion of MUC1* (FIG. 2A, D). Further, they show that these activating growth factors bind to the membrane proximal portion of MUC1*, as they do not bind to the PSMGFR peptide if the 10 C-terminal amino acids are missing. Similarly, anti-MUC1* antibodies MN-C2 and MN-E6 bind to the PSMGFR peptide if an only if the 10 C-terminal amino acids are present (FIG. 2 B, C). Antibodies MN-C3 and MN-C8 bind to epitopes that are different from MN-C2 and MN-E6, as they do not depend on the presence of the 10 C-terminal amino acids of the PSMGFR peptide (FIG. 2 E, F). Antibodies MN-C2, MN-E6, MN-C3 or MN-C8, or fragments derived from them, as stand-alone antibodies or incorporated into bispecific antibodies, BiTEs or chimeric antigen receptors also called CARs expressed by immune cells are all potent anti-cancer therapeutics.

Therapeutic anti-MUC1* antibodies for use as a stand alone antibody therapeutic or for integration into a BiTE or a CAR can be selected based on specific criteria. The parent antibody can be generated using typical methods for generating monoclonal antibodies in animals. Alternatively, they can be selected by screening antibody and antibody fragment libraries for their ability to bind to a MUC1* peptide, which can be the PSMGFR peptide (SEQ ID NO:2), SNIKFRPGSVVVQLTLAFREGTINVHDVETQFNQYK-TEAASRY (SEQ ID NO:620); or SVVVQLTLAFREGT-INVHDVETQFNQYKTEAASRY (SEQ ID NO:621).

Figure 3:
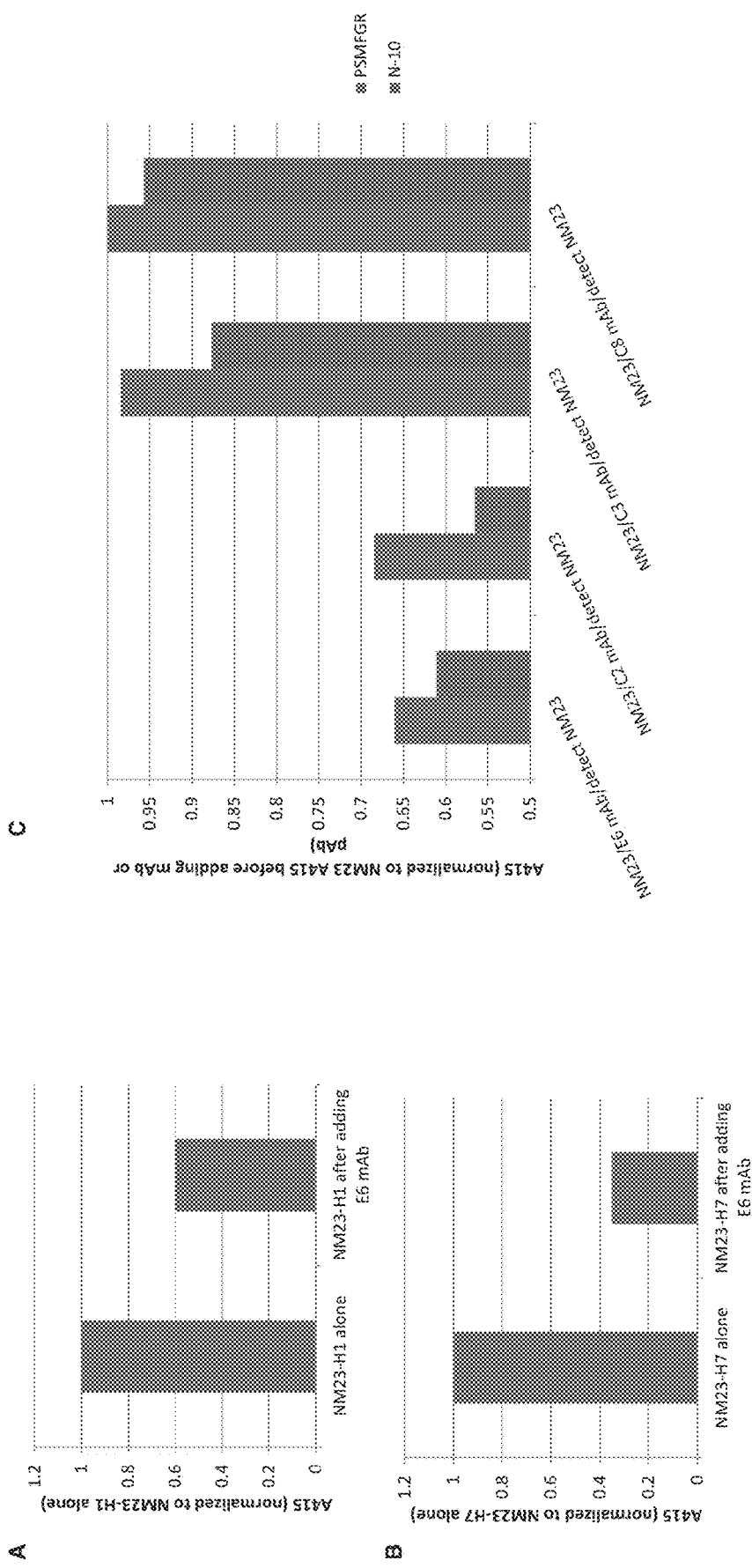
FIG. 3A-C show results of competitive ELISA assays. The PSMGFR MUC1* peptide is immobilized on the plate and dimeric NM23-H1, aka NME1, is added either alone or after the MN-E6 antibody has been added (A). The same experiment was performed wherein NM23-H7, NME7-AB, is added alone or after MN-E6 has been added (B). Results show that MN-E6 competitively inhibits the binding of MUC1* activating ligands NME1 and NME7. In a similar experiment (C), PSMGFR or PSMGFR minus 10 amino acids from the N-terminus, aka N-10, is immobilized on the plate. Dimeric NM23-H1 is then added. Anti-MUC1* antibodies MN-E6, MN-C2, MN-C3 or MN-C8 are then tested for their ability to compete off the NM23-H1. Results show that although all three antibodies bind to the PSMGFR peptides, MN-E6 and MN-C2 competitively inhibit binding of the MUC1* activating ligands.

Resultant antibodies or antibody fragments generated or selected in this way can then be further selected by passing additional screens. For example, antibodies or antibody fragments become more preferred based on their ability to bind to MUC1* positive cancer cells or tissues but not to MUC1 negative cancer cells or tissues. Further, anti-MUC1* antibodies or antibody fragments may be de-selected as anti-cancer therapeutics if they bind to stem or progenitor cells. Anti-MUC1* antibodies or antibody fragments become more preferred if they have the ability to competitively inhibit the binding of activating ligands to MUC1*. FIG. 3A-C shows that MN-E6 and MN-C2 competitively inhibit the binding of activating ligands NME1 and NME7 to MUC1*. A process for selecting anti-MUC1* antibodies for use in treating a patient diagnosed with a MUC1 positive cancer, at risk of developing a MUC1 positive cancer or suspected of having a MUC1 positive cancer comprises one or more of the following steps of selecting antibodies or antibody fragments that 1) bind to the PSMGFR peptide; 2) bind to the N-10 PSMGFR peptide; 3) bind to cancer cells; 4) do not bind to stem or progenitor cells; and 5) competitively inhibited the binding of dimeric NME1 or NME7-AB to the PSMGFR peptide. For example, FIG. 3A-C show that monoclonals MN-E6 and MN-C2 satisfy all five criteria, while monoclonals MN-C3 and MN-C8 do not competitively inhibit the binding of activating ligands NME1 and NME7 (Figure M3 C). However, antibodies or antibody fragments derived from MN-C3 and MN-C8 are equally potent as anti-cancer agents when integrated into a BiTE or a CAR as in these methods, the killing effect of the immune cells is more important than the ability to inhibit the binding of activating ligands. In addition, toxic agents conjugated to MN-E6, MN-C2, MN-C3 or MN-C8 are potent anti-cancer therapeutics. Recall that the MUC1* growth factor receptor is activated by ligand-induced dimerization of its extracellular domain. Therefore the ideal antibody therapeutic should not dimerize the MUC1* extracellular domain. Preferably, suitable antibodies in this regard include monovalent antibodies such as those generated in lamas and camels, Fabs, scFv's, single domain antibodies (sdAb), scFv-Fc as long as the Fc portion is constructed such that it does not homo-dimerize.

Figure 4:
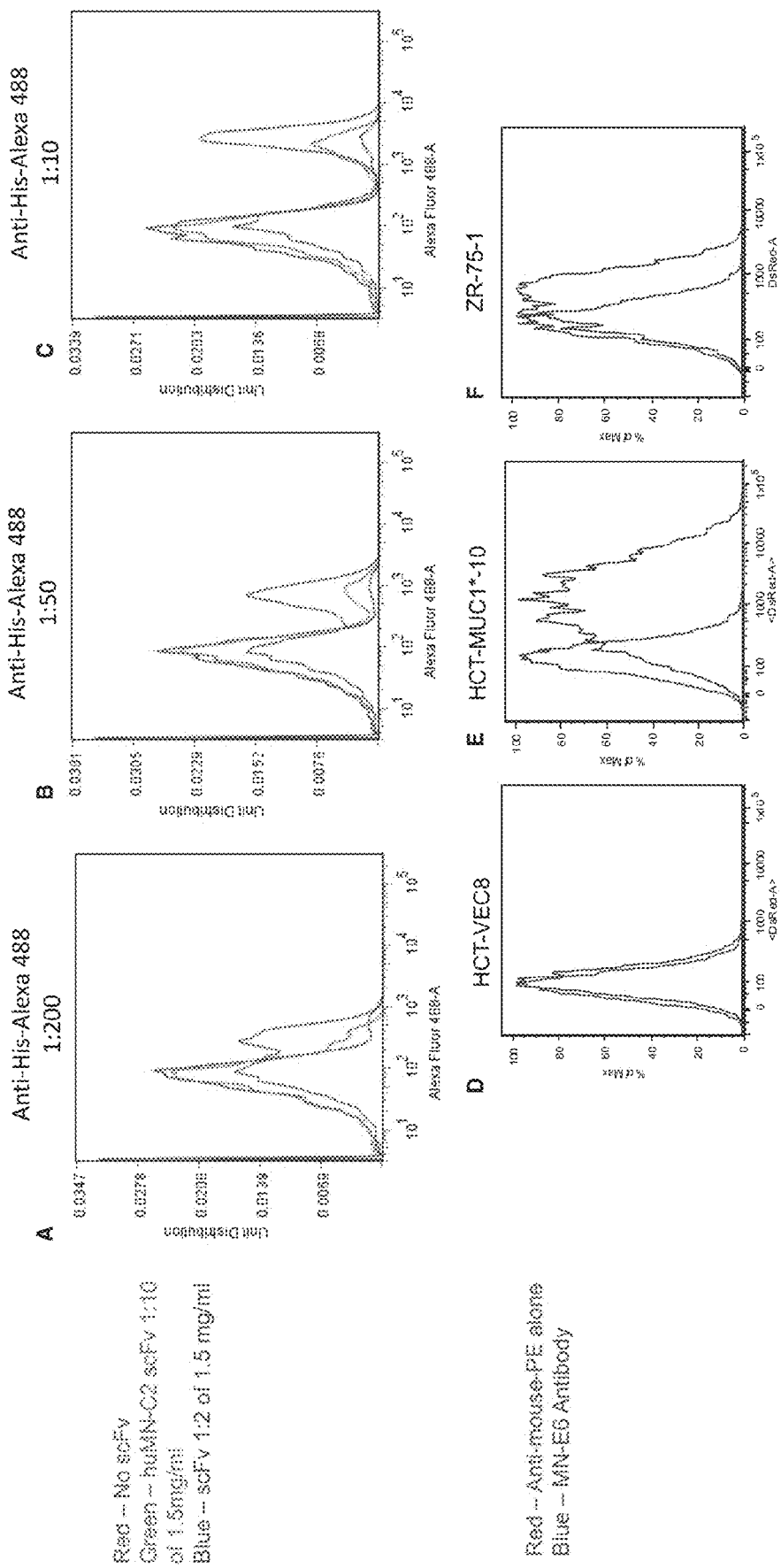
FIG. 4A-F shows FACS scans of anti-MUC1* antibodies binding specifically to MUC1* positive cancer cells and MUC1* transfected cells but not MUC1* or MUC1 negative cells. ZR-75-1, aka 1500, MUC1* positive breast cancer cells were stained with 1:2 or 1:10 dilutions of the 1.5 ug/ml humanized MN-C2. After two washes, cells were stained with secondary antibody, Anti-Penta-His antibody at conjugated to Alexa 488 (Qiagen) dilutions of 1:200 (A), 1:50 (B), or 1:10 (C) to detect the 6x His tag on the huMN-C2 scFv. Flow cytometric analysis revealed a concentration-dependent shift of a subset of cells, indicating specific binding, which is unseen in the absence of the MN-C2 scFv (A-C). In another case, MN-E6 was used to stain MUC1 negative HCT-116 colon cancer cells transfected with the empty vector, single cell clone #8 (D), HCT-116 colon cancer cells transfected with MUC1* single cell clone #10 (E), or ZR-75-1, aka 1500, MUC1* positive breast cancer cells. As the FACS scans show, both MN-C2 and MN-E6 only stain MUC1* positive cells and not MUC1 or MUC1* negative cells.
Figure 5:
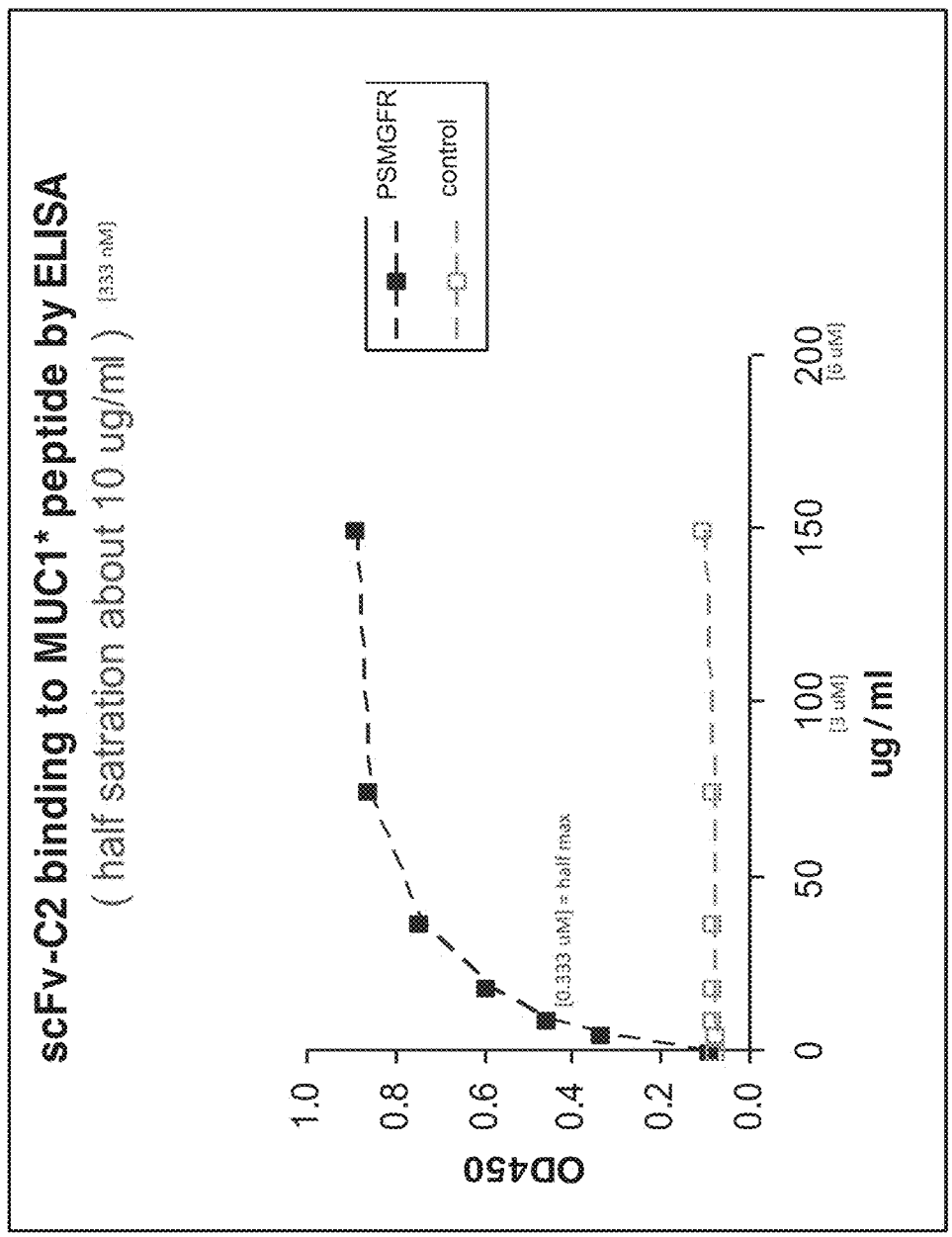
FIG. 5 shows a graph of an ELISA in which surface is coated with either the MUC1* PSMGFR peptide or a control peptide. Humanized MN-C2 scFv is then incubated with the surface, washed and detected according to standard methods. The ELISA shows that the huMN-C2 scFv binds to the MUC1* peptide with an EC-50 of about 333 nM.
Figure 6:
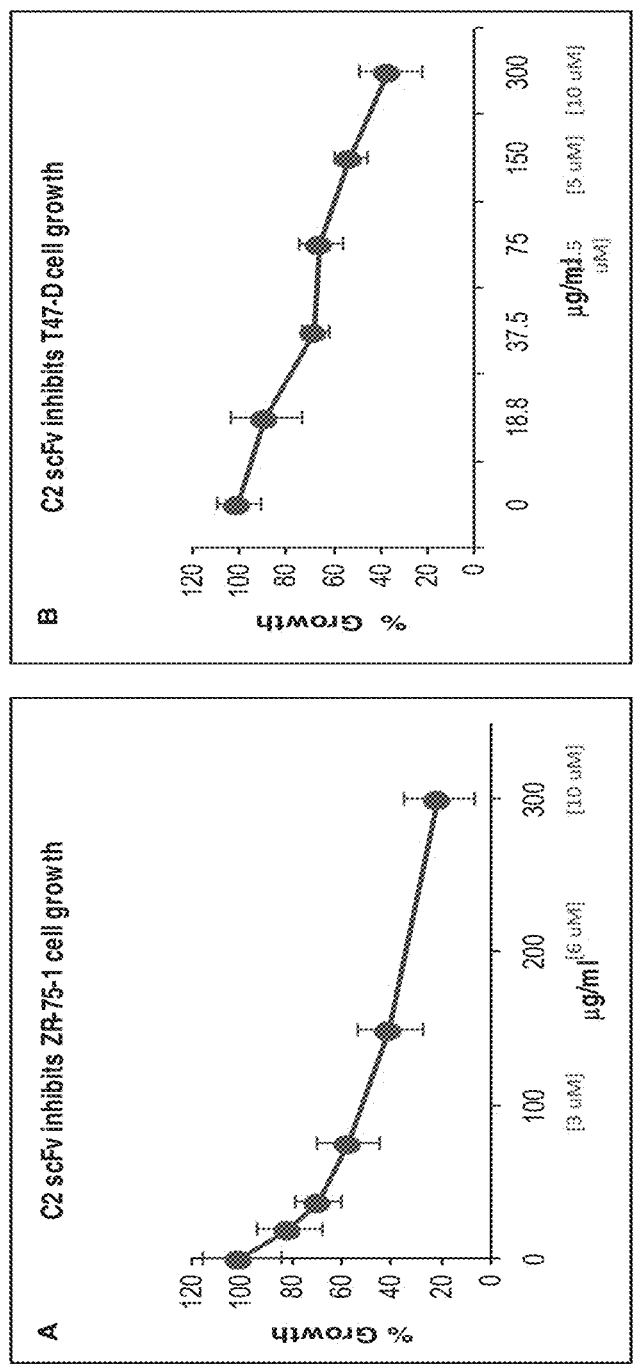
FIG. 6A-B shows graphs of cancer cell growth inhibition by MUC1* antibody variable region fragment humanized MN-C2 scFv. hMN-C2 scFv potently inhibited the growth of ZR-75-1, aka 1500, MUC1* positive breast cancer cells (A) and T47D MUC1* positive breast cancer cells (B) with approximately the same EC-50 as the in vitro ELISAs.

FACS scans show that anti-MUC1* antibodies MN-C2, MN-E6, MN-C3 and MN-C8 specifically bind to MUC1* positive cancer cells and MUC1* transfected cells but not MUC1* or MUC1 negative cells. In one example, a humanized MN-C2 scFv is shown to bind to ZR-75-1, aka 1500, MUC1* positive breast cancer cells (FIG. 4A-C). MN-E6 was shown to bind to MUC1 negative HCT-116 colon cancer cells if an only if they were transfected with MUC1*. MN-E6 also bound to MUC1* positive cancer cells such as ZR-75-1, aka 1500, MUC1* positive breast cancer cells (FIG. 4 D-F). Binding assays such as ELISAs, immunofluorescence, and the like all confirm that MN-C2 and MN-E6 bind to the PSMGFR peptide and to live MUC1 positive cancer cells. Humanized anti-MUC1* antibodies are selected based on their ability to also bind to the PSMGFR peptide or to MUC1 positive cancer cells. FIG. 5 shows that humanized MN-C2 scFv binds with high affinity to the MUC1* peptide PSMGFR with an EC-50 of about 333 nM. Humanized MN-C2 scFv, like Fabs, potently inhibits the growth of MUC1* positive cancer cells as is shown in one example in FIG. 6A, B.

Figure 7:
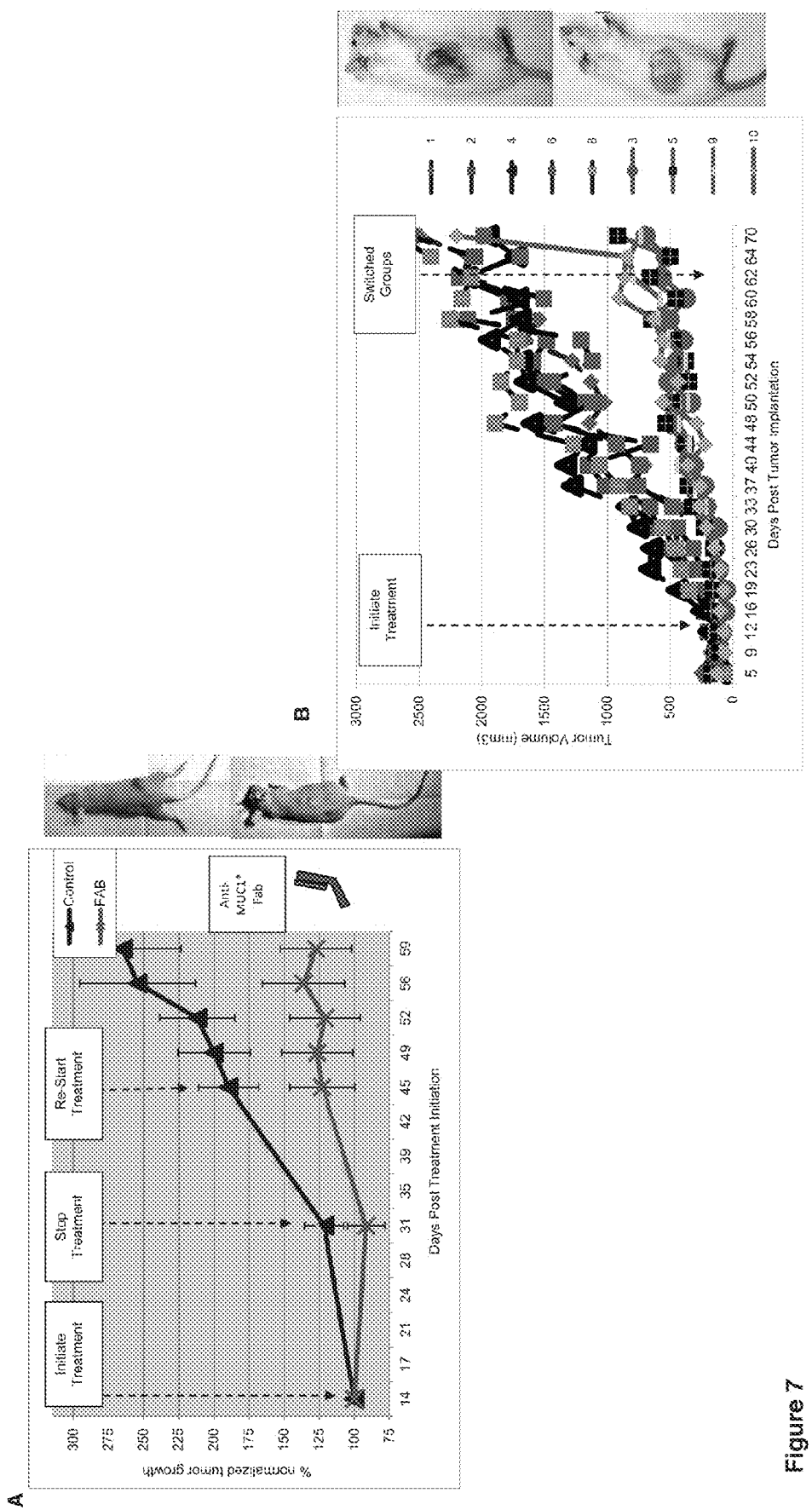
FIG. 7A-B shows graphs of tumor growth in immune compromised mice that have been implanted with human tumors then treated with anti-MUC1* antibody MN-E6 Fab or mock treatment. Female nu/nu mice implanted with 90-day estrogen pellets were implanted with 6 million T47D human breast cancer cells that had been mixed 50/50 with Matrigel. Mice bearing tumors that were at least 150 mm$^3$ and had three successive increases in tumor volume were selected for treatment. Animals were injected sub cutaneously twice per week with 80 mg/kg MN-E6 Fab and an equal number of mice fitting the same selection criteria were injected with vehicle alone (A). Male NOD/SCID mice were implanted with 6 million DU-145 human prostate cancer cells that had been mixed 50/50 with Matrigel. Mice bearing tumors that were at least 150 mm$^3$ and had three successive increases in tumor volume were selected for treatment. Animals were injected sub-cutaneously every 48 hours with 160 mg/kg MN-E6 Fab and an equal number of mice fitting the same selection criteria were injected with vehicle alone (B). Tumors were measured independently by two researchers twice per week and recorded. Statistics were blindly calculated by independent statistician, giving a P value of 0.0001 for each. Anti-MUC1* Fab inhibited breast cancer growth and prostate cancer growth. Treatment had no effect on weight, bone marrow cell type or number.

The Fabs of MN-E6 and MN-C2 or the comparable single chain variable regions derived from them potently inhibit the growth of MUC1* positive cancers in vitro and in vivo. In several examples, the Fabs of Anti-MUC1* antibodies inhibited the growth of human MUC1* positive cancers in vivo. In one case, immune-compromised mice were implanted with human breast tumors then treated with MN-E6 Fab after tumor engraftment. FIG. 7A shows that MN-E6 Fab potently inhibited the growth of MUC1* positive breast cancers. Female nu/nu mice implanted with 90-day estrogen pellets were implanted with 6 million T47D human breast cancer cells that had been mixed 50/50 with Matrigel. Mice bearing tumors that were at least 150 mm^3 and had three successive increases in tumor volume were selected for treatment. Animals were injected sub cutaneously twice per week with 80 mg/kg MN-E6 Fab and an equal number of mice fitting the same selection criteria were injected with vehicle alone (A). In another aspect, MN E6 was shown to halt the growth of prostate cancer. FIG. 7B shows that MN-E6 Fab potently inhibited the growth of MUC1* positive prostate cancers. Male NOD/SCID mice were implanted with 6 million DU-145 human prostate cancer cells that had been mixed 50/50 with Matrigel. Mice bearing tumors that were at least 150 mm^3 and had three successive increases in tumor volume were selected for treatment. Animals were injected sub-cutaneously every 48 hours with 160 mg/kg MN-E6 Fab and an equal number of mice fitting the same selection criteria were injected with vehicle alone (B). Tumors were measured independently by two researchers twice per week and recorded. Statistics were blindly calculated by independent statistician, giving a P value of 0.0001 for each. Anti-MUC1* Fab inhibited breast cancer growth and prostate cancer growth. Treatment had no effect on weight, bone marrow cell type or number. The MN-E6 Fab effectively inhibited the growth of the tumors, while the control group's tumors continued to grow until sacrifice. No adverse effects of treatment were observed or detected.

Figure 13:
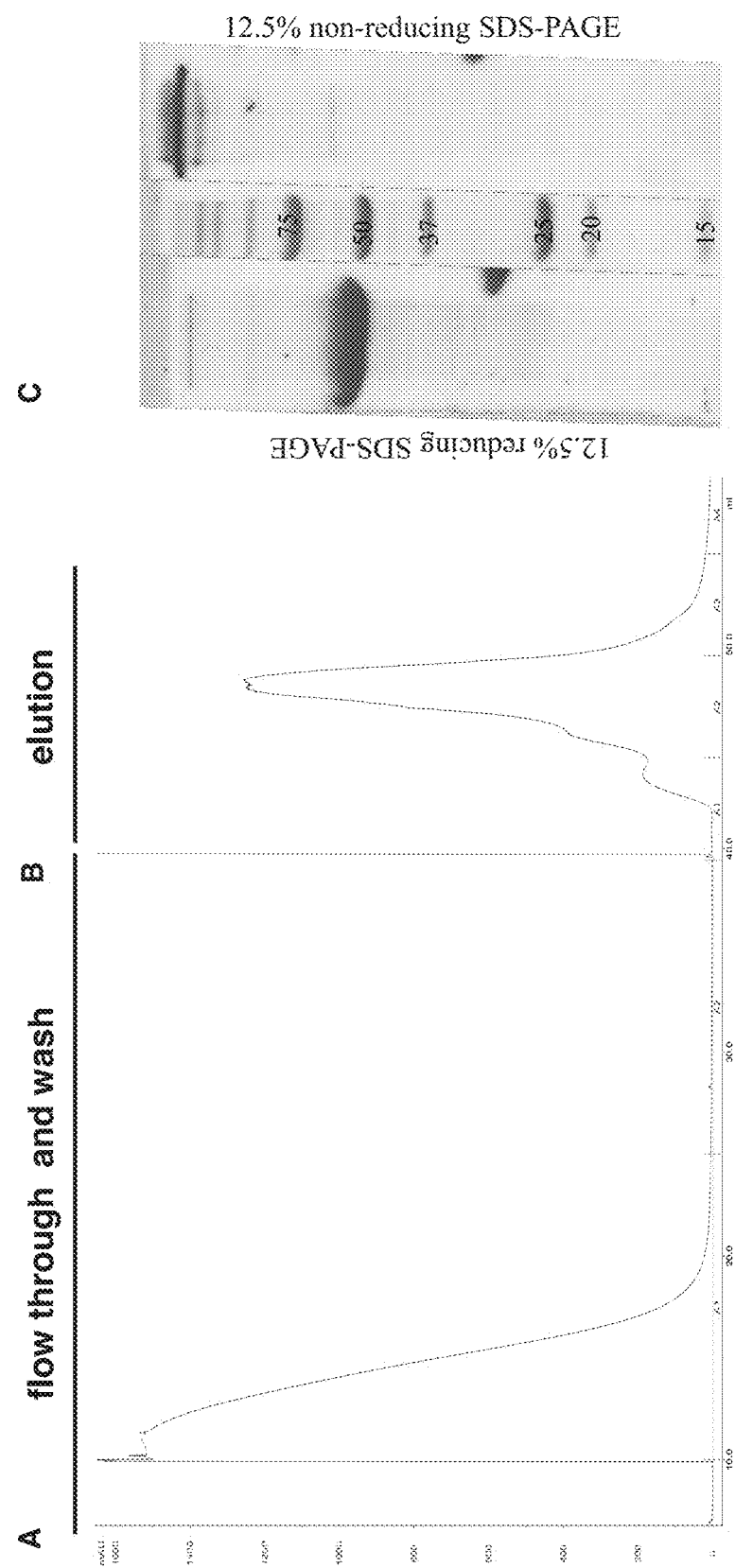
FIG. 13A-C shows FPLC traces of the purification of MN-E6 scFv-Fc fusion protein that was grown in low IgG FBS over a Protein A affinity column. A) is the trace of the flow through. B) is the trace of the elution. C) shows the purified protein on a reducing or non-reducing gel.
Figure 14:
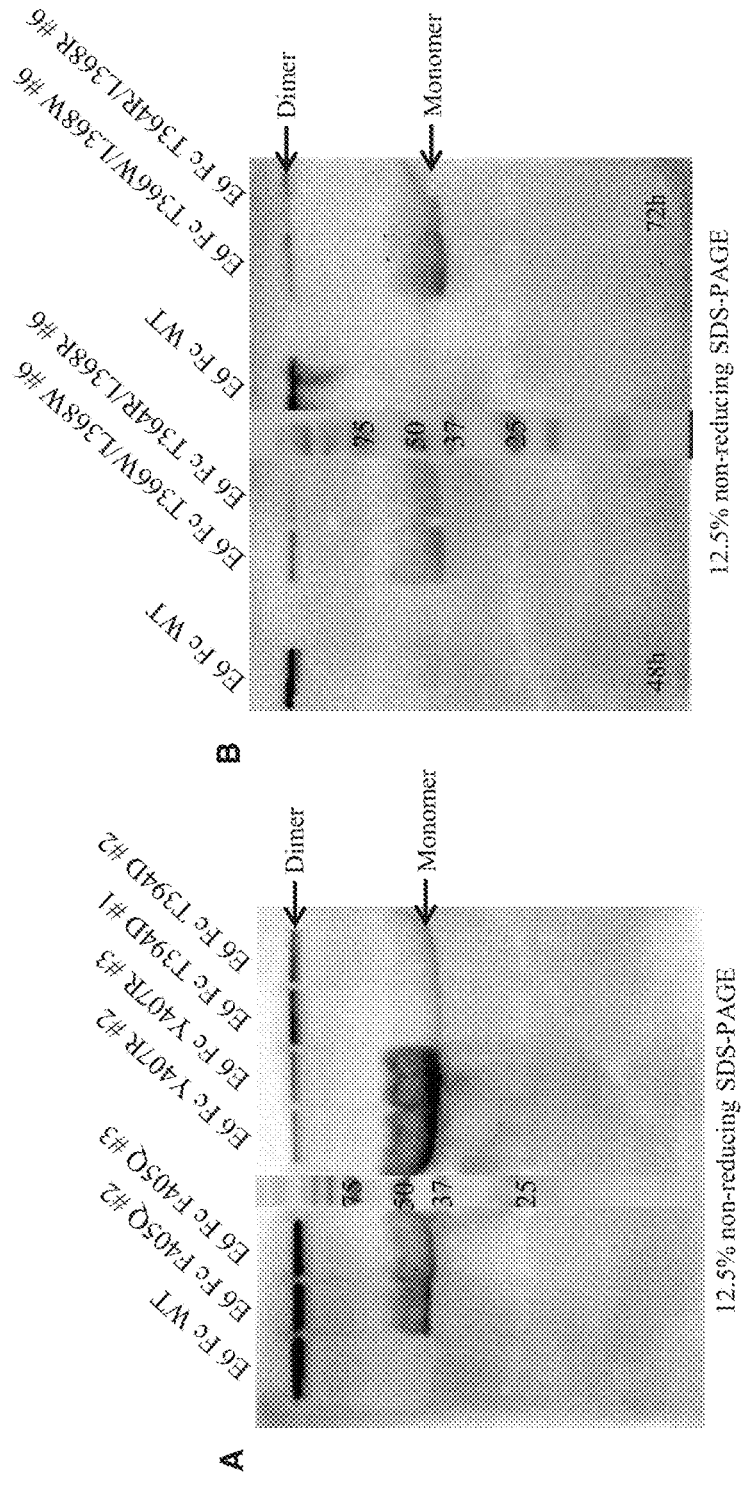
FIG. 14A-B shows photographs of SDS-PAGE characterization of purified MN-E6 scFv-Fc fusion proteins on a non-reducing gels, wherein the Fc portion that was fused to the MN-E6 was either wild type (wt) or mutated as follows: A) F405Q, Y407R, T394D; B) T366W/L368W, T364R/L368R, T366W/L368W or T364R/L368R. Fc mutants F405Q, Y407R, T366W/L368W, T364R/L368R, T366W/L368W and T364R/L368R all favored monomer over dimer formation. The reference construct amino acid sequence for the indicated mutations is SEQ ID NO:273.
Figure 15:
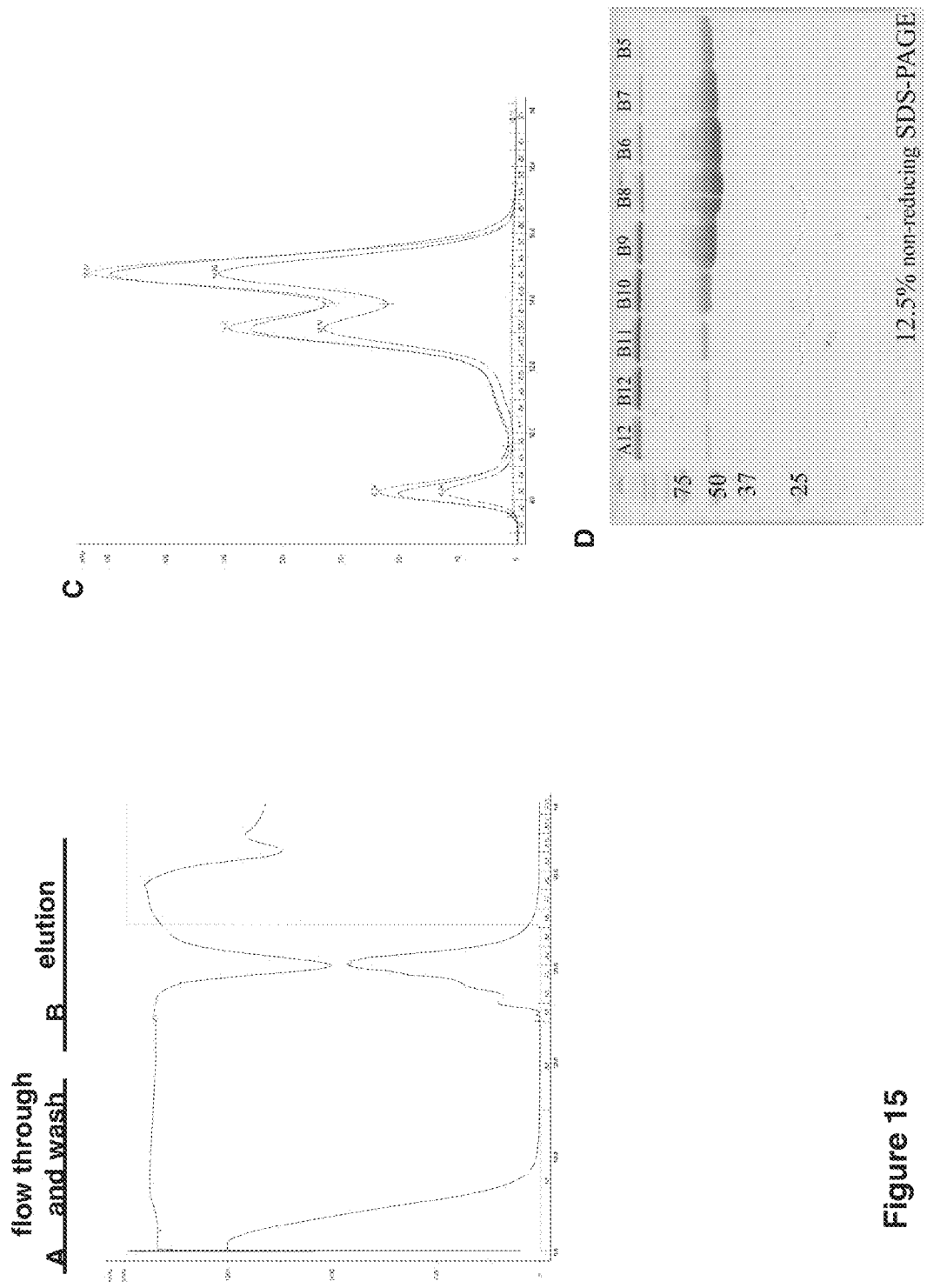
FIG. 15A-B shows FPLC traces of the purification of MN-E6 scFv-Fc Y407Q fusion protein that was grown in low IgG FBS over a Protein A affinity column. A) is the trace of the flow through. B) is the trace of the elution. The protein was further purified by size exclusion over an S200 column (C). (D) is a photograph of an SDS-PAGE gel showing which fractions had a predominance of monomer. The reference construct amino acid sequence for the indicated mutations is SEQ ID NO:273.
Figure 16:
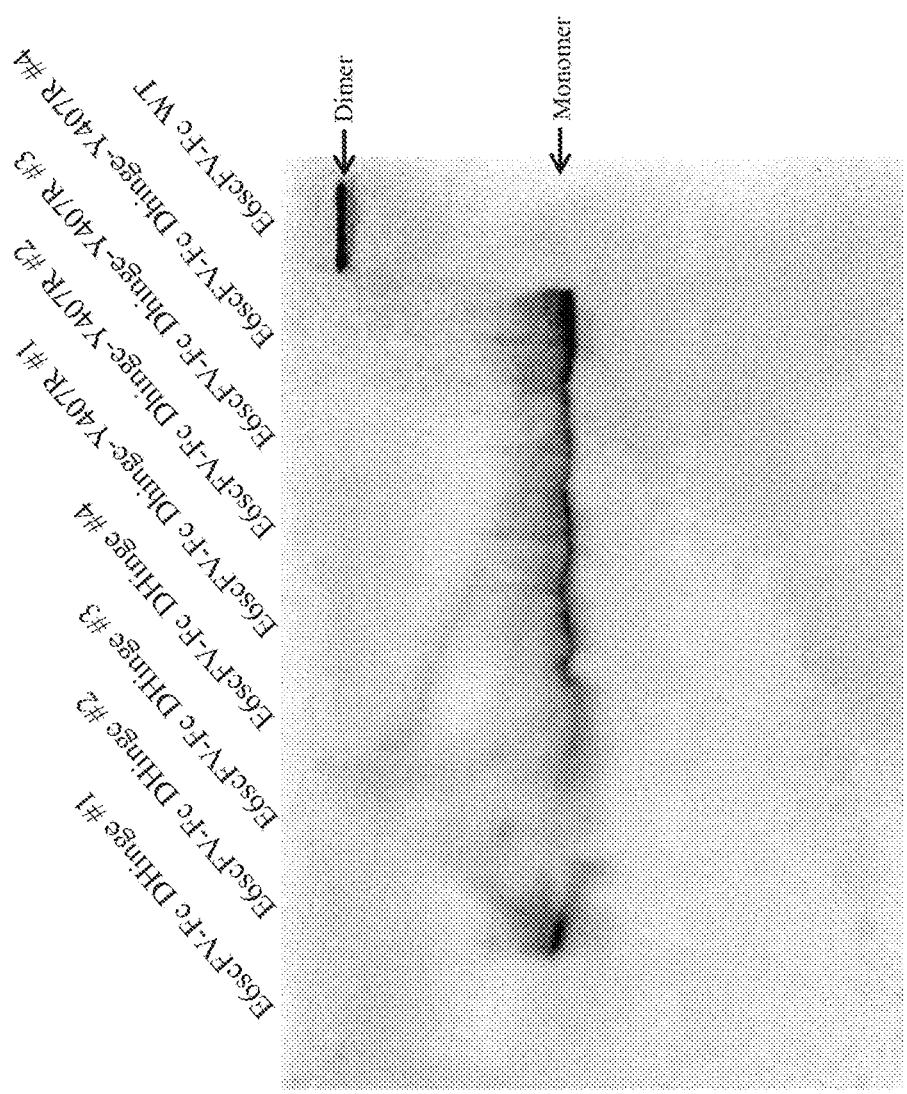
FIG. 16 shows a photograph of SDS-PAGE characterization of purified MN-E6 scFv-Fc-mutant fusion proteins on a non-reducing gel, wherein the Fc portion that was fused to the MN-E6 scFv was either wild type (wt) or mutated by elimination of the hinge region, 'DHinge', of the Fc or elimination of the hinge region of the Fc and also bearing the Y407R mutation. All the Fc mutants favored monomer over dimer formation. The reference construct amino acid sequence for the indicated mutations is SEQ ID NO:273.
Figure 17:
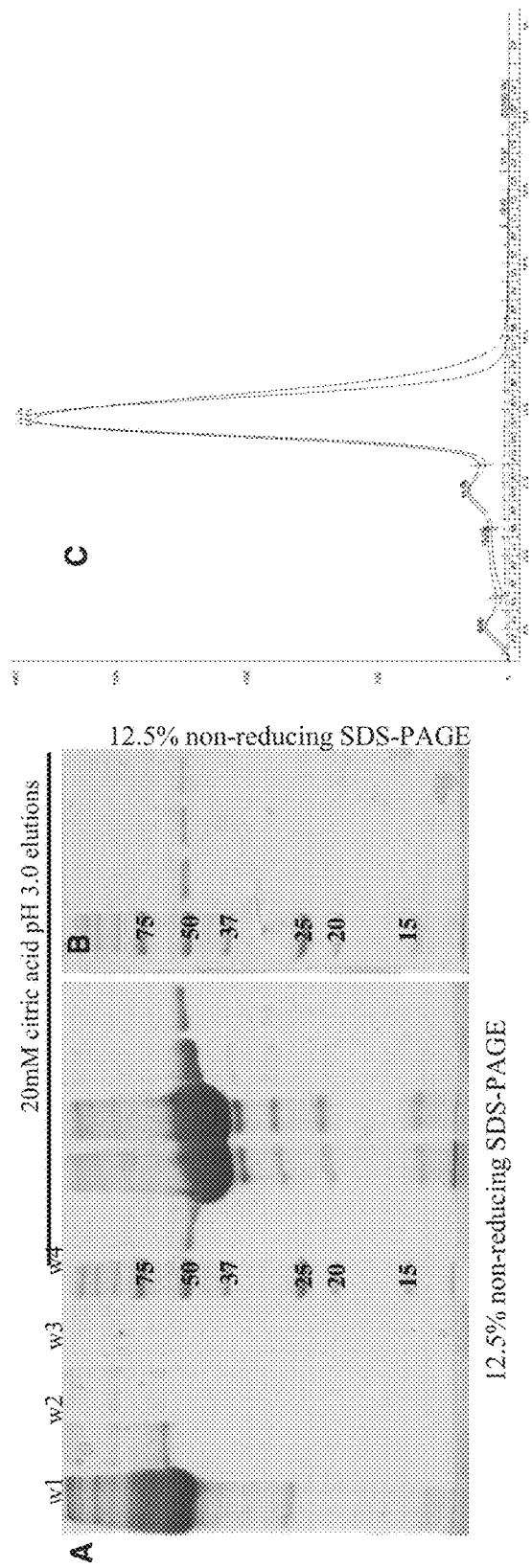
FIG. 17A-C. A and B show photograph of non-reducing SDS-PAGE characterization of large scale expression and purification of MN-E6 scFv-Fc hingeless mutant, showing that it is a monomer. FPLC characterization and purification of MN-E6 scFv-Fc hingeless mutant is shown (C).
Figure 18:
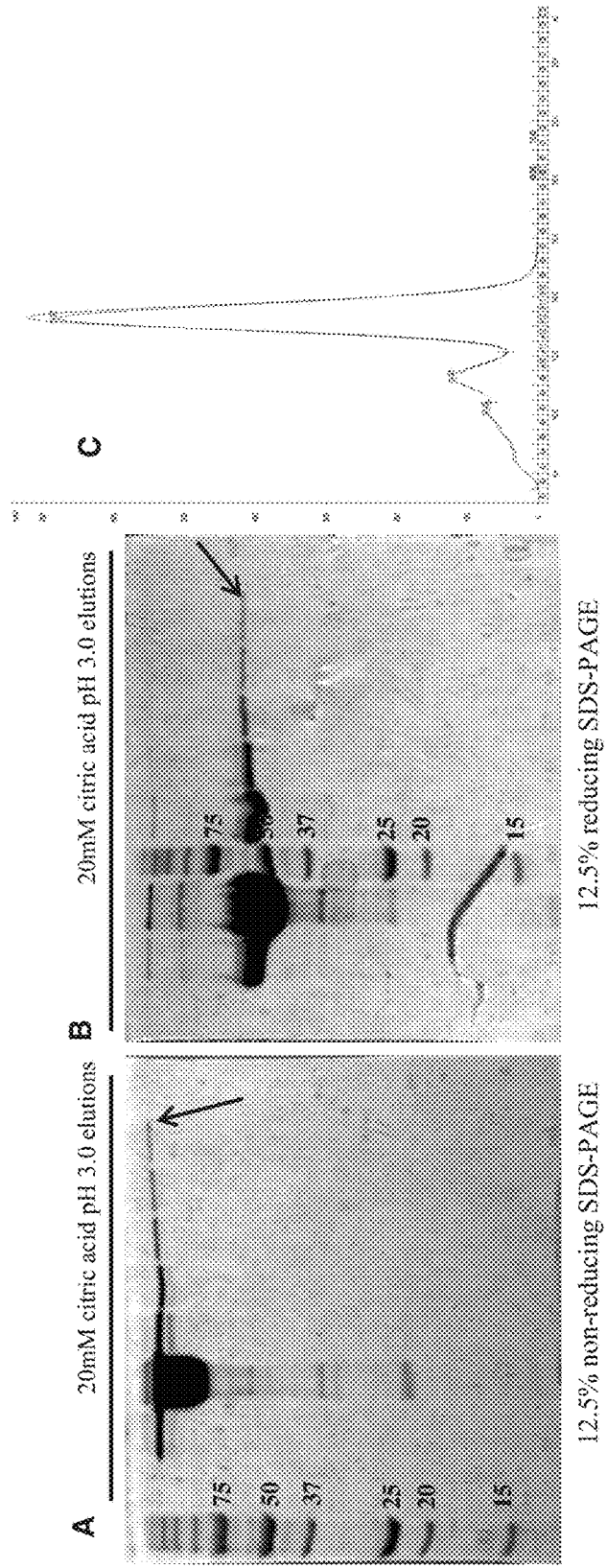
FIG. 18A-C shows photographs of the SDS-PAGE characterization of the purified MN-C3 scFv-Fc fusion protein on a non-reducing gel (A) or a reducing gel (B). The protein was purified by size exclusion. The FPLC trace is shown (C).
Figure 19:
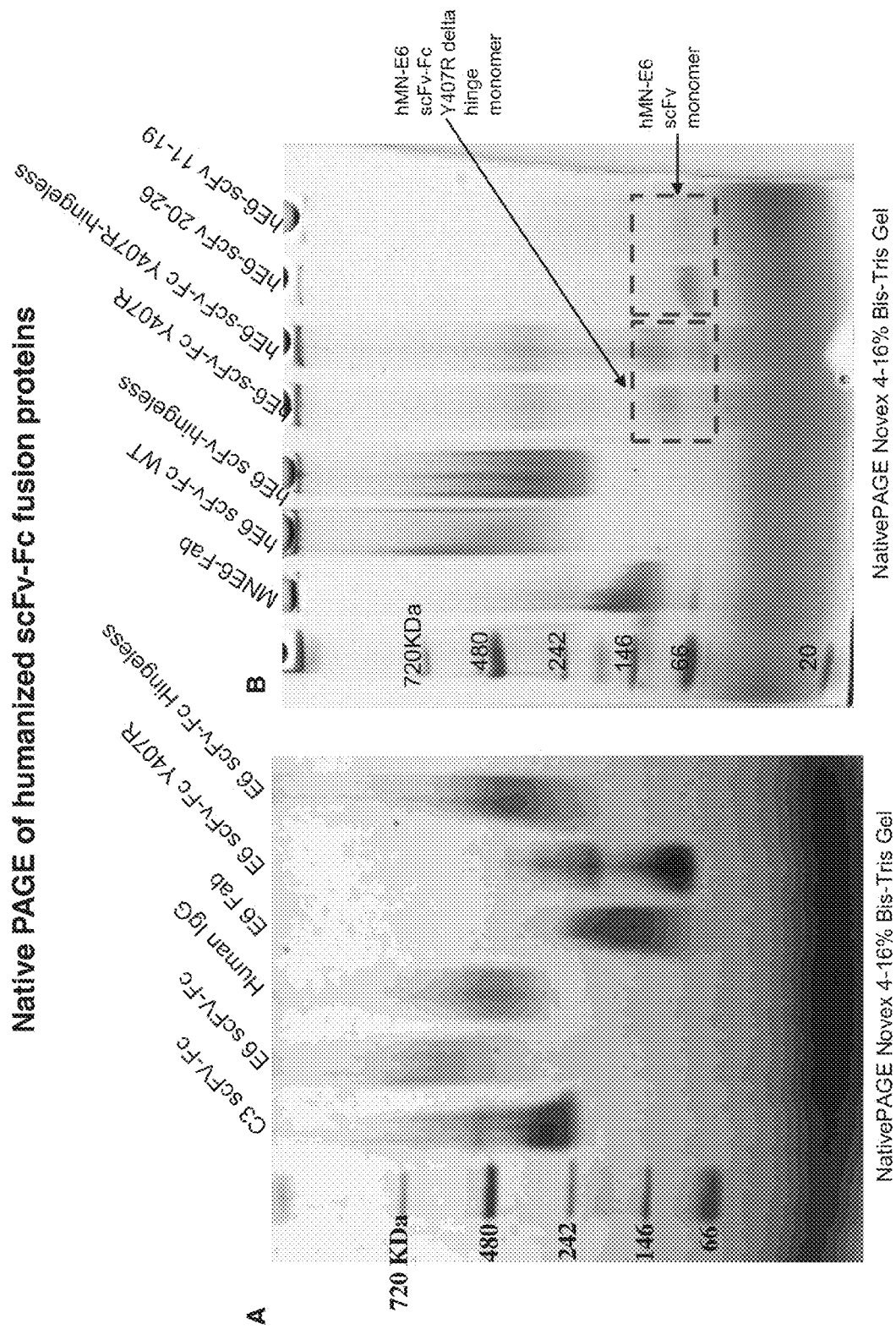
FIG. 19A-B shows photographs of Native gels of MN-C3 or MN-E6 Fabs, scFv, scFv-Fc, wherein the Fc portion is wild type or mutants that prefer or are exclusively monomers. Native gels show that the Y407R Fc mutation (A) and the double mutant Y407R and a deleted hinge (B) favor monomer over dimer the best. Note that proteins are loaded onto a gel at much higher concentrations than typical use concentrations. The dimer formation of other Fc mutants may only reflect the fact that loading concentration is very high.

A recombinant MN-E6 was constructed that like the Fab is monomeric. In this case, MN-E6 was humanized. There are a number of methods known to those skilled in the art for humanizing antibodies. In addition to humanizing, libraries of human antibodies can be screened to identify other fully human antibodies that bind to the PSMGFR. A single chain of the humanized MN-E6 variable region, called an scFv, was genetically engineered such that it was connected to the Fc portion of the antibody (SEQ ID NO:256 and 257). Fc regions impart certain benefits to antibody fragments for use as therapeutics. The Fc portion of an antibody recruits complement, which in general means it can recruit other aspects of the immune system and thus amplify the anti-tumor response beyond just inhibiting the target. The addition of the Fc portion also increases the half-life of the antibody fragment (Czajkowsky D M, Hu J, Shao Z and Pleass R J. (2012) Fc-fusion proteins: new developments and future perspectives. EMBO Mol Med. 4(10):1015-1028). However, the Fc portion of an antibody homo-dimerizes, which in the case of anti-MUC1* antibody based therapeutics is not optimal since ligand-induced dimerization of the MUC1* receptor stimulates growth. As can be seen in FIG. 13 B, humanized MN-E6 scFv-Fc is a dimer, in part due to disulfide bonding. Therefore, mutations in the Fc region that resist dimer formation are preferred for anti-MUC1* anti-cancer therapeutics. Deletion of the hinge region (hingeless also called delta hinge or Dhinge in some figures and examples SEQ ID NO: 288 and 289) and other mutations in the Fc region that make the Fc-mutant resistant to dimerization were made. The following mutations were made in the CH3 domain to create a monomeric scFv-Fc fusion protein: Y407R (SEQ ID NO: 278 and 279), F405Q (SEQ ID NO: 280 and 281), T394D (SEQ ID NO: 282 and 283), T366W/L368W (SEQ ID NO: 284 and 285), T364R/L368R (SE ID NO: 286 and 287). FIG. 14 shows photographs of SDS-PAGE characterization of purified MN-E6 scFv-Fc fusion proteins on a non-reducing gels, wherein the Fc portion that was fused to the MN-E6 was either wild type (wt) or mutated as follows: A) F405Q, Y407R, T394D; B) T366W/L368W, T364R/L368R, T366W/L368W or T364R/L368R. Fc mutants F405Q, Y407R, T366W/L368W, T364R/L368R, T366W/L368W and T364R/L368R all favored monomer over dimer formation. FIG. 15 shows FPLC traces of the purification of MN-E6 scFv-Fc Y407Q fusion protein that was grown in low IgG FBS over a Protein A affinity column. A) is the trace of the flow through. B) is the trace of the elution. The protein was further purified by size exclusion over an 5200 column (C). (D) is a photograph of an SDS-PAGE gel showing which fractions had a predominance of monomer. FIG. 16 shows a photograph of SDS-PAGE characterization of purified MN-E6 scFv-Fc-mutant fusion proteins on a non-reducing gel, wherein the Fc portion that was fused to the MN-E6 scFv was either wild type (wt) or mutated by elimination of the hinge region, 'DHinge', of the Fc or elimination of the hinge region of the Fc and also bearing the Y407R mutation. All the Fc mutants favored monomer over dimer formation. The reference construct amino acid sequence for the indicated mutation is SEQ ID NO:273. Other relevant sequences are SEQ ID NOS:289 and 279. FIG. 17A-C. A and B show photograph of non-reducing SDS-PAGE characterization of large scale expression and purification of MN-E6 scFv-Fc hingeless mutant, showing that it is a monomer. FPLC characterization and purification of MN-E6 scFv-Fc hingeless mutant is shown (C). FIG. 18A-C shows photographs of the SDS-PAGE characterization of the purified MN-C3 scFv-Fc fusion protein on a non-reducing gel (A) or a reducing gel (B). The protein was purified by size exclusion. The FPLC trace is shown (C). FIG. 19 A-B shows photographs of Native gels of MN-C3 or MN-E6 Fabs, scFv, scFv-Fc, wherein the Fc portion is wild type or mutants that prefer or are exclusively monomers. Native gels show that the Y407R Fc mutation (A) and the double mutant Y407R and a deleted hinge (B) favor monomer over dimer the best. Note that proteins are loaded onto a gel at much higher concentrations than typical use concentrations. The dimer formation of other Fc mutants may only reflect the fact that loading concentration is very high.

Figure 10:
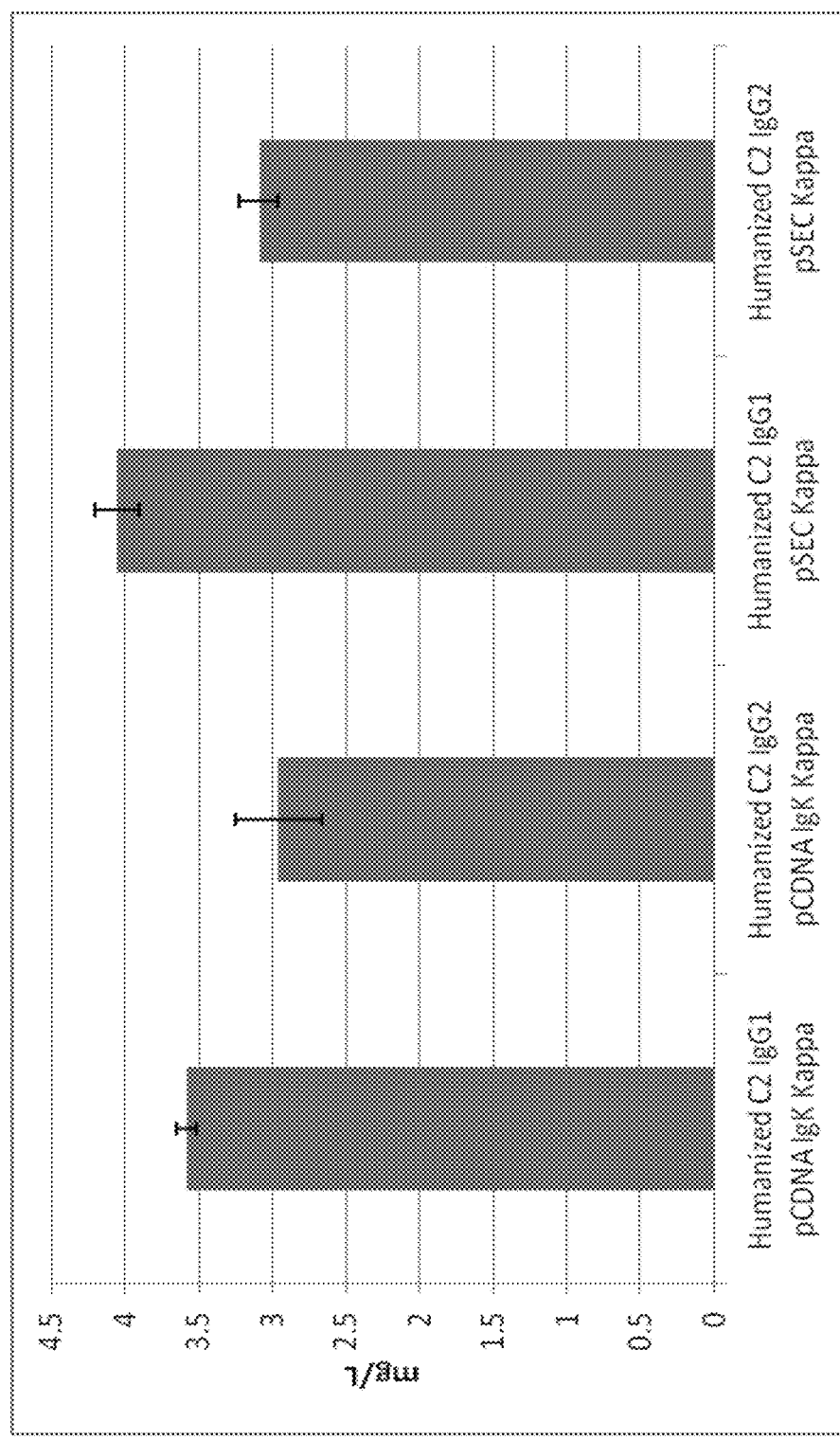
FIG. 10 is a graph of an ELISA assay showing differing levels of expression of humanized MN-C2 anti-MUC1* antibody depending on whether the light chain was kappa or lambda and whether the variable portion was fused to a human IgG1 or IgG2.

Some mutations or deletions were so effective that, even when loaded onto a gel at high concentrations, they resist dimer formation (FIG. 14A, B). The Y407R mutation results in a nearly pure population of dimeric scFv-Fc (FIG. 10). Similarly deletions of the hinge region of the Fc result in fusion proteins that are monomers rather than dimers. Combinations of mutations can result in even more effective resistance of dimer formation (FIGS. 16 and 17). These and other mutations and combinations thereof were introduced into CH2-CH3 (SEQ ID NO:274 and 275) and CH3 (SEQ ID NO:276 and 277) fusion proteins such as scFv or in the hingeless Fc-fusion proteins such as scFv and were shown to eliminate or minimize dimerization.

Figure 20:
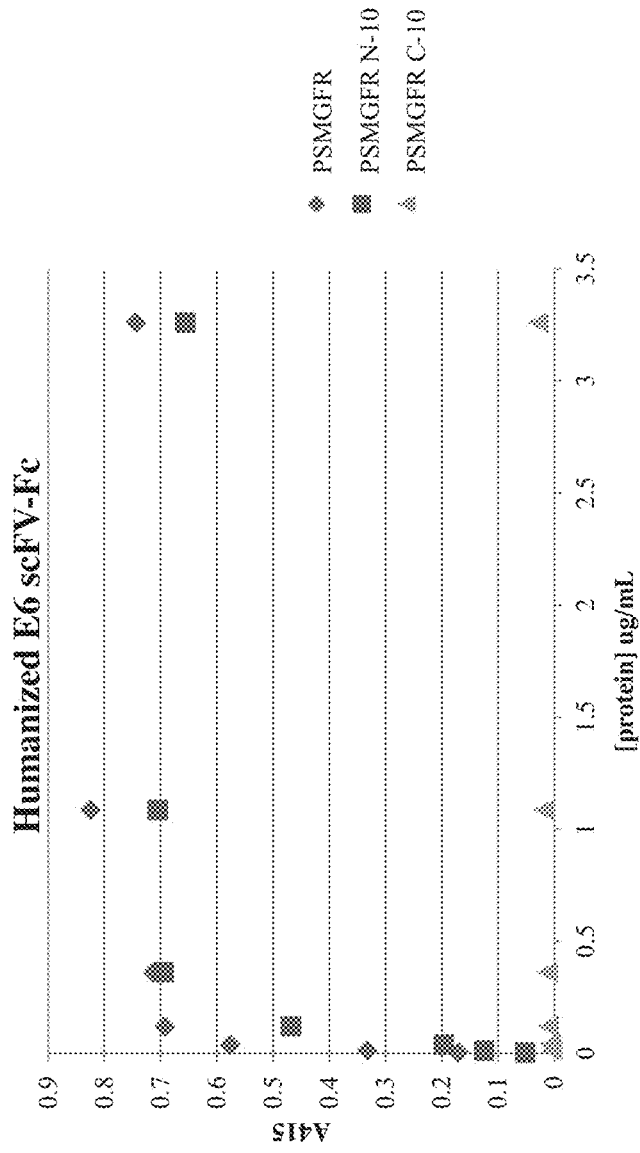
FIG. 20 shows a graph of an ELISA wherein the surface was immobilized with either PSMGFR peptide, PSMGFR minus 10 amino acids from the N-terminus or minus 10 amino acids from the C-terminus. The hu MN-E6 scFv-Fc bound to the PSMGFR peptide and to the PSMGFR N-10 peptide but not to the PSMGFR C-10 peptide. The parent MN-E6 antibody and the humanized MN-E6 require the C-terminal 10 amino acids of PSMGFR for binding.
Figure 21:
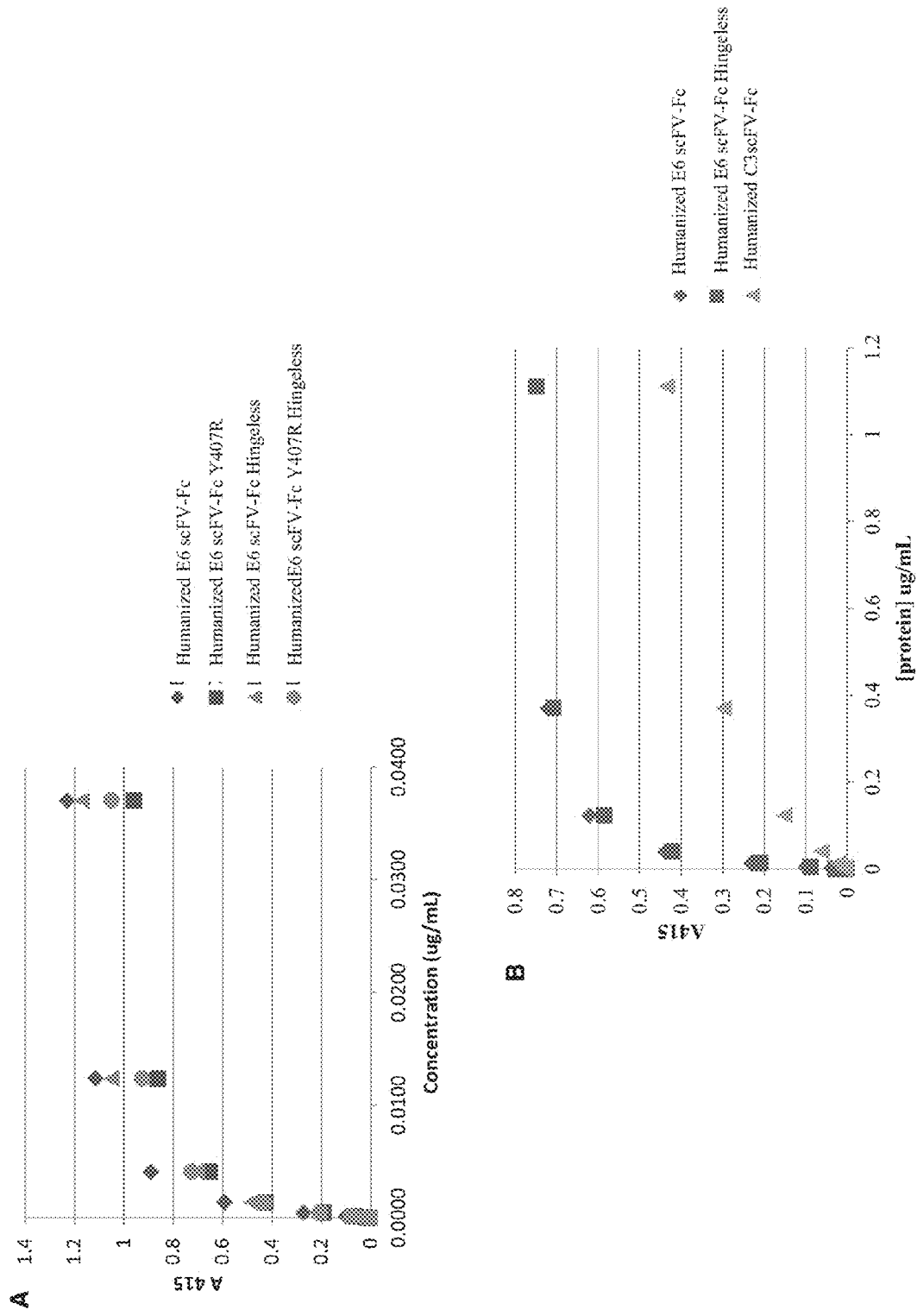
FIG. 21A-B shows an ELISA graph of several anti-MUC1* scFv-Fc fusion proteins wherein the Fc region has been eliminated or mutated. Shown are hu MN-E6 scFv-Fc-wt, hu MN-E6 scFv-Fc-Y407R, hu MN-E6 scFv-Fc-hingeless, and hu MN-E6 scFv-Fc-Y407R-hingeless. All mutants bind to the PSMGFR peptide of the MUC1* extracellular domain (A). An ELISA graph of several anti-MUC1* scFv-Fc fusion proteins wherein the Fc region is either wild type or mutated. Shown are hu MN-E6 scFv-Fc-wt, hu MN-E6 scFv-Fc-hingeless, and hu MN-C3 scFv-Fc is shown (B). All bind to the PSMGFR peptide of the MUC1* extracellular domain.
Figure 22:
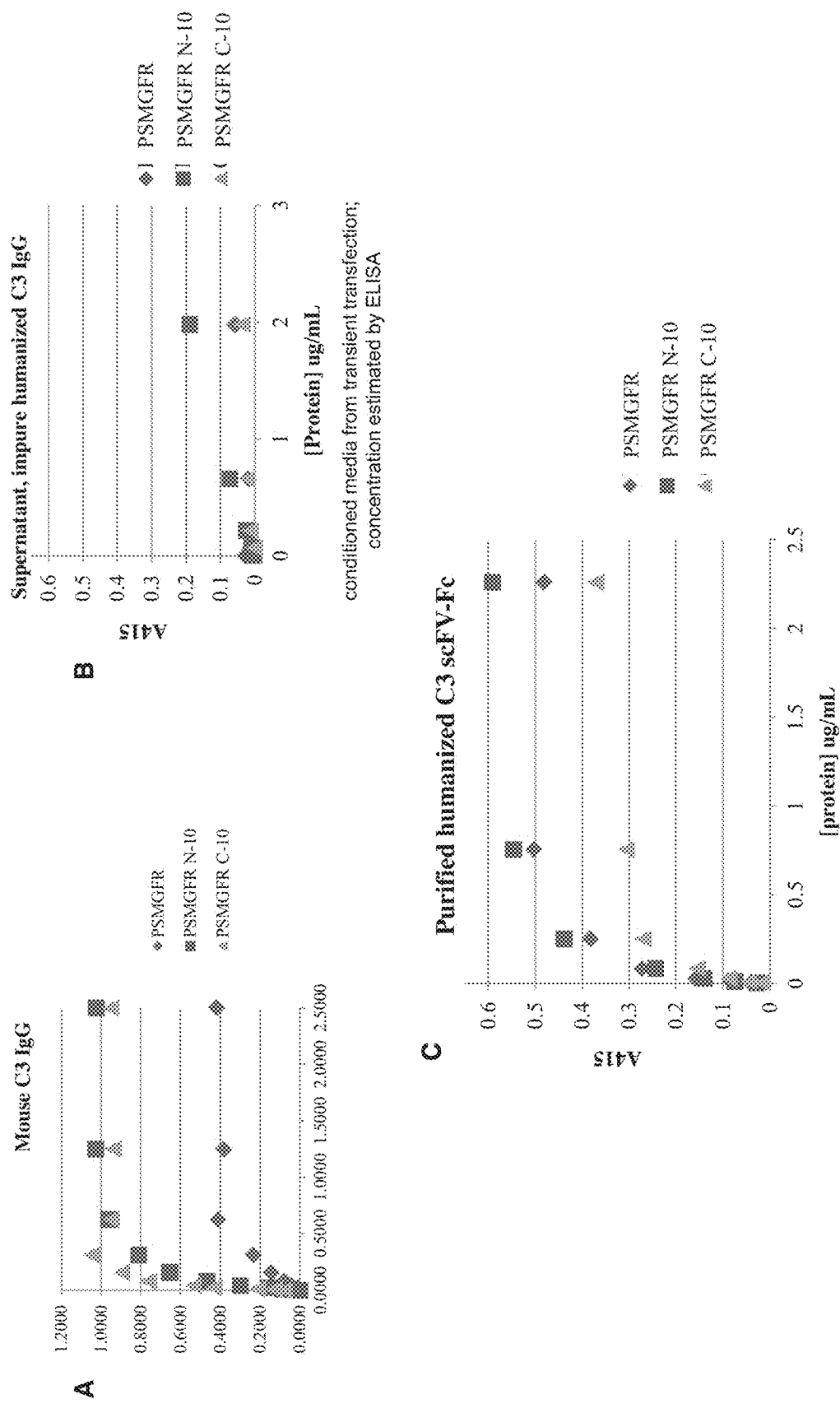
FIG. 22A-C shows graphs of ELISAs wherein the assay plate surface was immobilized with either PSMGFR peptide, PSMGFR minus 10 amino acids from the N-terminus or minus 10 amino acids from the C-terminus. The MN-C3 antibody variants were then assayed for binding to the various MUC1* peptides. A) Purified mouse monoclonal MN-C3 antibody; B) Impure humanized MN-C3 antibody; and C) the humanized MN-C3 scFv-Fc. ELISAs show binding to the PSMGFR peptide as well as to certain deletion peptides.
Figure 23:
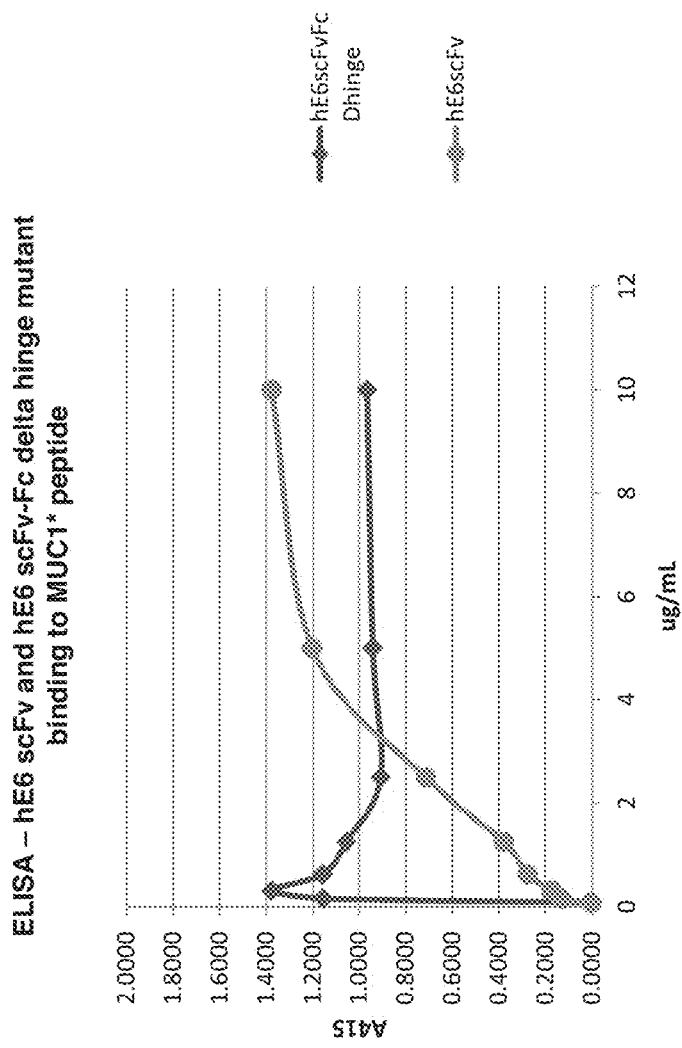
FIG. 23 shows a graph of an ELISA assay that quantifies the binding of humanized MN-E6 scFv-Fc-delta hinge, aka Dhinge or hingeless, and humanized MN-E6 scFv to the MUC1* peptide PSMGFR.

Like the parent mouse monoclonal antibodies, human or humanized antibodies as well as single chain constructs, scFv's, scFv-Fc fusions or scFv-Fc-mutants specifically bind to the synthetic MUC1* peptides (FIGS. 20-22). Figure E23 shows a graph of an ELISA assay that quantifies the binding of humanized MN-E6 scFv-Fc-delta hinge, aka Dhinge or hingeless, and humanized MN-E6 scFv to the MUC1* peptide PSMGFR.

Figure 24:
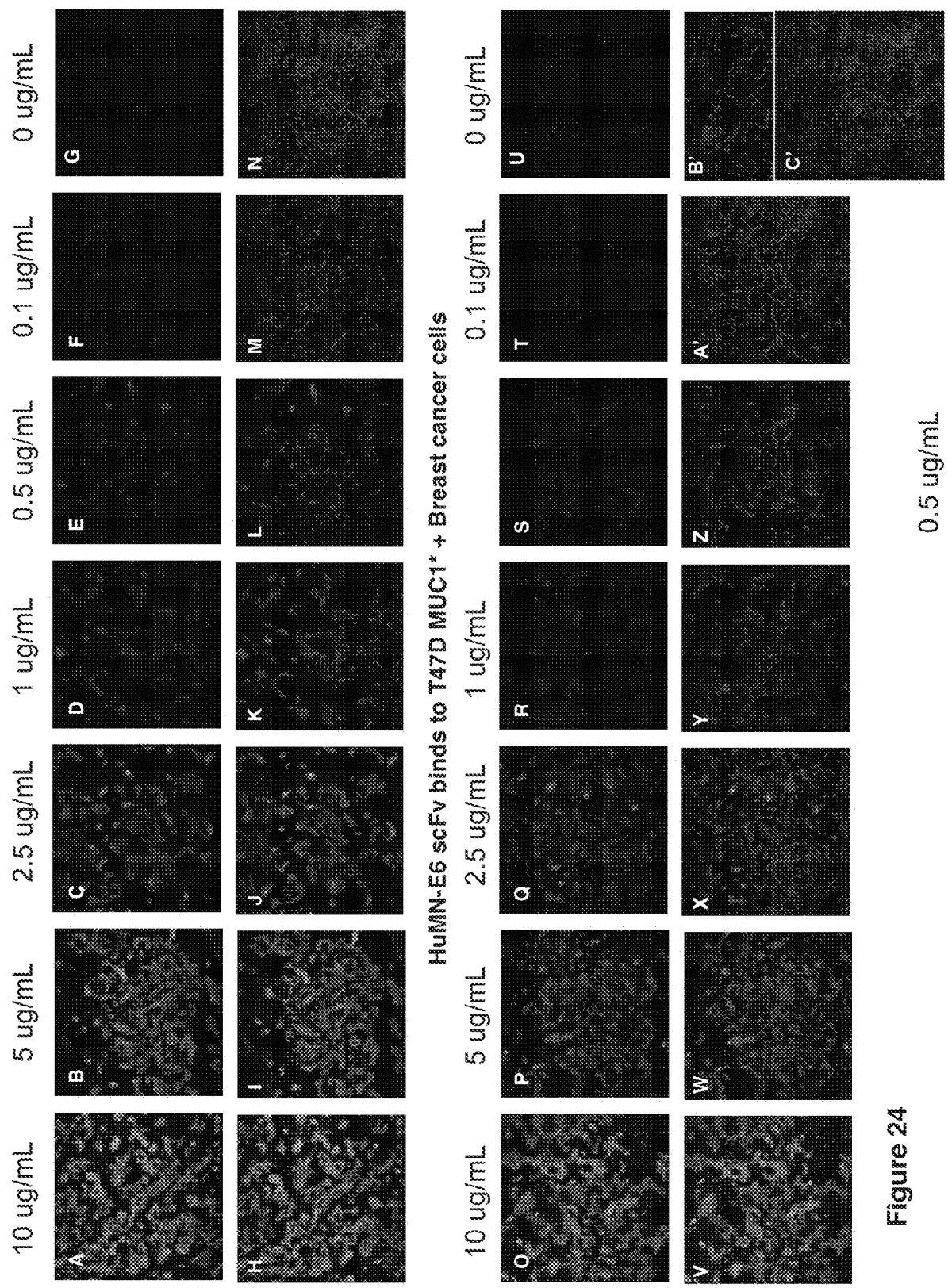
FIG. 24 shows photographs of immunofluorescence experiments in which humanized MN-C2 scFv or MN-E6 scFv specifically binds to MUC1* positive breast cancer cells in an identical concentration dependent manner. A-G: hu MN-C2 scFv binding to T47D breast cancer cells at concentrations indicated. H-N shows the fluorescently labeled scFv and DAPI. O-U: hu MN-E6 scFv binding to T47D breast cancer cells at concentrations indicated. V-B' shows the fluorescently labeled scFv and DAPI. C' is the secondary antibody control.
Figure 25:
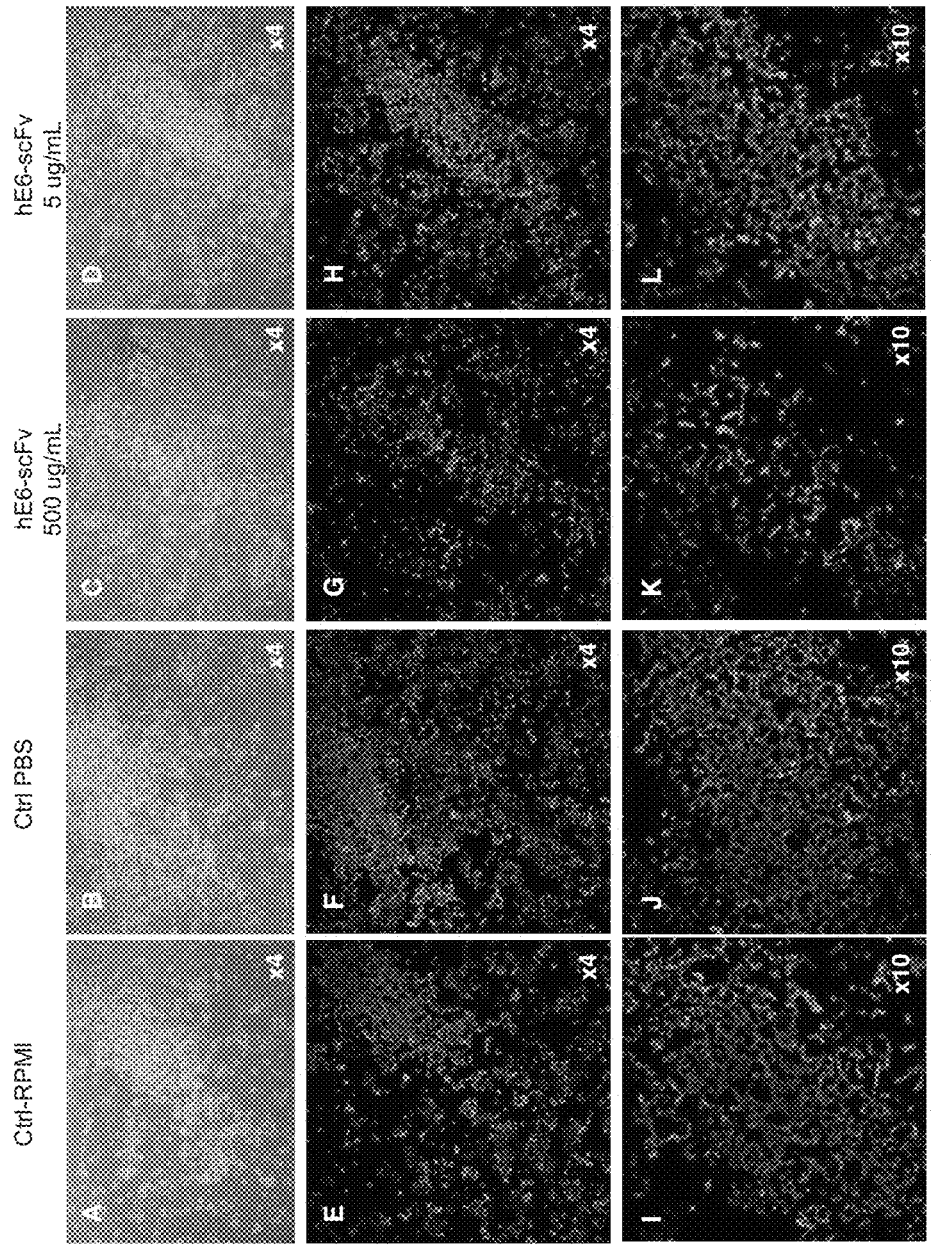
FIG. 25A-L shows photographs of 1500 MUC1* positive breast cancer cells that have been cultured in normal medium or in the presence of humanized MN-E6 scFv. A-D are bright field images taken at 4× magnification. E-H are calcein fluorescent images taken at 4× magnification. I-L are calcein fluorescent images taken at 10× magnification. A,E, I show control cells cultured in normal RPMI medium. B,F, J show control cells cultured in normal RPMI medium plus a volume of PBS equal to the volume of MN-E6 scFv in PBS that is added to experimental wells. C, G, K show cells cultured in normal RPMI medium plus 500 ug/mL MN-E6 scFv. D, H, L show cells cultured in normal RPMI medium plus 5 ug/mL MN-E6 scFv. The photographs show killing and/or growth inhibition of MUC1* positive cells by MN-E6 scFv at 5 ug/mL and an even greater effect at 500 ug/mL. Images were taken at 96 hours post addition of test molecule.
Figure 26:
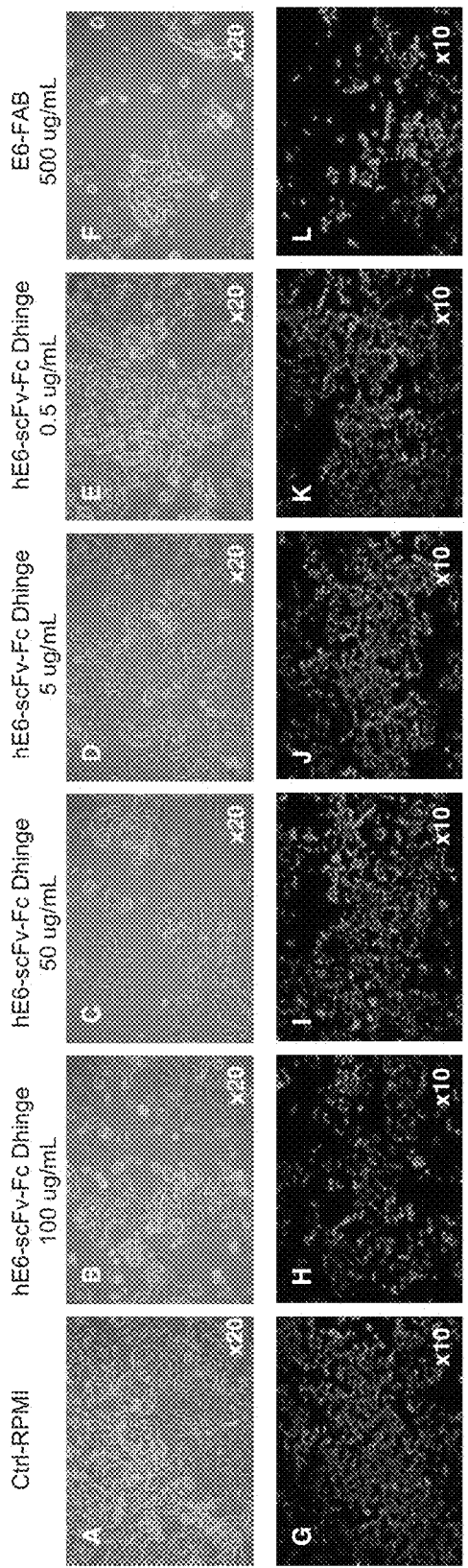
FIG. 26A-L shows photographs of 1500 MUC1* positive breast cancer cells that have been cultured in normal medium or in the presence of humanized MN-E6 scFv-Fc Dhinge, which is a hingeless or delta hinge mutant. A-F are bright field images taken at 20× magnification. G-L are calcein fluorescent images taken at 4× magnification. A, G show control cells cultured in normal RPMI medium. B, H show cells cultured in normal RPMI medium plus 100 ug/mL hMN-E6 scFv-Fc Dhinge. C, I show cells cultured in normal RPMI medium plus 50 ug/mL hMN-E6 scFv-Fc Dhinge. D, J show cells cultured in normal RPMI medium plus 5 ug/mL hMN-E6 scFv-Fc Dhinge. E, K show cells cultured in normal RPMI medium plus 0.5 ug/mL hMN-E6 scFv-Fc Dhinge. F, L show cells cultured in normal RPMI medium plus 500 ug/mL of MN-E6 Fab. The photographs show killing and/or growth inhibition of MUC1* positive cells by hMN-E6 scFv-Fc Dhinge 5 ug/mL, an even greater effect at 50 ug/mL and yet an even greater effect at 100 ug/mL. Comparing cell morphology to the control cells, cancer cells grown in MN-E6 Fab or in an effective amount of hMN-E6 scFv-Fc Dhinge, show rounding up of the cells which morphology change occurs before cell death. Images were taken at 96 hours post addition of test molecule.

The human or humanized anti-MUC1* antibody fragments described here specifically bind to MUC1 and MUC1* positive cancer cells. FIG. 24 shows photographs of immunofluorescence experiments in which humanized MN-C2 scFv or MN-E6 scFv specifically binds to MUC1* positive breast cancer cells in an identical concentration dependent manner. A-G: hu MN-C2 scFv binding to T47D breast cancer cells at concentrations indicated. H-N shows the fluorescently labeled scFv and DAPI. O-U: hu MN-E6 scFv binding to T47D breast cancer cells at concentrations indicated. V-B' shows the fluorescently labeled scFv and DAPI. C' is the secondary antibody control.

Figure 27:
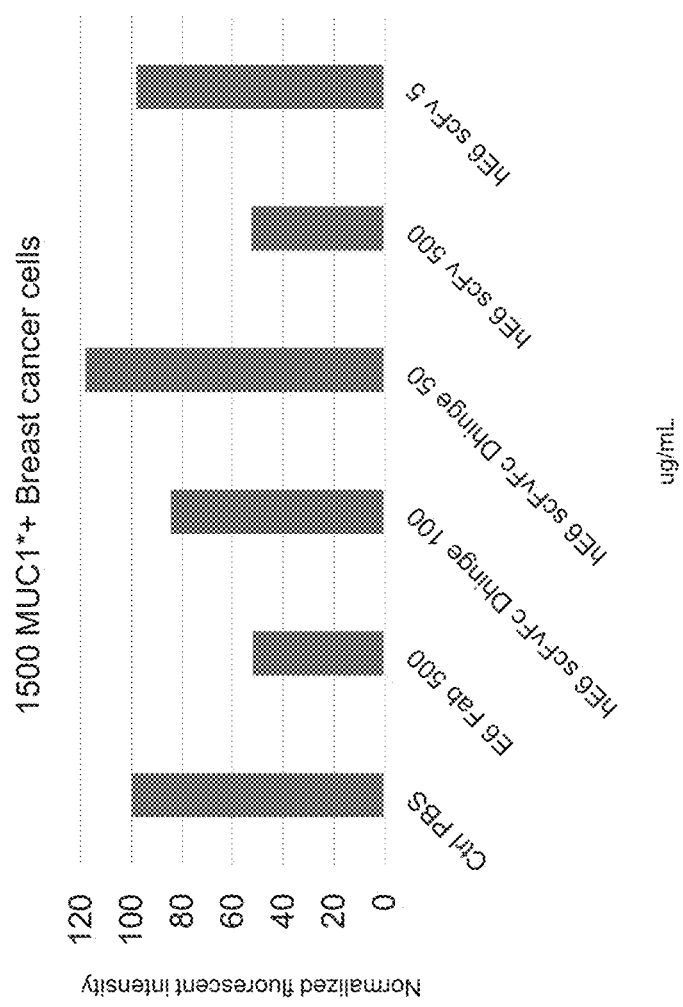
FIG. 27 shows a graph of the image analysis of the fluorescent images of FIGS. 25 and 26. Image J was used to quantify the number of cells remaining after 96 hours treatment in humanized MN-E6scFv or MN-E6 scFv-Fc-delta hinge, aka Dhinge. The analysis software uses pixel counting and pixel fluorescence intensity to quantify the number of cells in each photograph. Analysis was performed over the entire image 512×512 pixels, 8-bit image. For comparison, the inhibition of mouse monoclonal MN-E6 Fab is also analyzed.

In addition to binding to MUC1* positive cancer cells, the anti-MUC1* antibody variable region fragments, scFv's, scFv-Fc's and scFv-Fc-mutants inhibited growth of MUC1-positive cancer cells. FIG. 25A-L shows photographs of MUC1* positive breast cancer cells that have been cultured in normal medium or in the presence of humanized MN-E6 scFv. The photographs show killing and/or growth inhibition of MUC1* positive cells by MN-E6 scFv at 5 ug/mL and an even greater effect at 500 ug/mL. FIG. 26A-L shows photographs of MUC1* positive breast cancer cells that have been cultured in normal medium or in the presence of humanized MN-E6 scFv-Fc Dhinge, which is a hingeless or delta hinge mutant. The photographs show killing and/or growth inhibition of MUC1* positive cells by hMN-E6 scFv-Fc Dhinge 5 ug/mL, an even greater effect at 50 ug/mL and yet an even greater effect at 100 ug/mL. FIG. 27 shows a graph of the image analysis of the fluorescent images of FIGS. 25 and 26. Image J was used to quantify the number of cells remaining after 96 hours treatment in humanized MN-E6scFv or MN-E6 scFv-Fc-delta hinge, aka Dhinge. The analysis software uses pixel counting and pixel fluorescence intensity to quantify the number of cells in each photograph. Analysis was performed over the entire image 512×512 pixels, 8-bit image. For comparison, the inhibition of mouse monoclonal MN-E6 Fab is also analyzed.

These data show that a human or humanized MN-E6 antibody or antibody fragment, Fab, MN-E6 scFv or hu MN-E6 scFv-Fc$_{mut}$ are effective anti-cancer agents that can be administered to a person diagnosed with a MUC1 or MUC1* positive cancer, suspected of having a MUC1 or MUC1* positive cancer or is at risk of developing a MUC1 or MUC1* positive cancer.

In these specific examples, the dimer resistant Fc that was fused onto an antibody fragment or scFv is hu MN-E7 scFv. However, any of these Fc region mutations or combinations thereof that eliminate or minimize dimerization can be fused onto variable region fragments or single chain constructs of MN-E6, MN-C2, MN-C3 or MN-C8 or other antibodies identified that selectively bind to MUC1* as it exists on cancer cells or tissues. In addition, the Fabs of these antibodies can be used as an anti-cancer therapeutic. In one aspect of the invention, a person diagnosed with, suspected of having or is at risk of developing a MUC1* or MUC1 positive cancer is treated with an effective amount of human or humanized MN-E6 scFv, MN-C2 scFv, MN-C3 scFv, or MN-C8 scFv. In another aspect of the invention, a person diagnosed with, suspected of having or is at risk of developing a MUC1* or MUC1 positive cancer is treated with an effective amount of human or humanized MN-E6 scFv-Fc$_{Y407R}$, MN-C2 scFv-Fc$_{Y407R}$, MN-C3 scFv-Fc$_{Y407R}$, or MN-C8 scFv-Fc$_{Y407R}$. In another aspect of the invention, a person diagnosed with, suspected of having or is at risk of developing a MUC1* or MUC1 positive cancer is treated with an effective amount of human or humanized MN-E6 scFv-Fc mutant$_{Dhinge}$, MN-C2 scFv-Fc mutant$_{Dhinge}$, MN-C3 scFv-Fc mutant$_{Dhinge}$, or MN-C8 scFv-Fc mutant$_{Dhinge}$. In yet another aspect of the invention, a person diagnosed with, suspected of having or is at risk of developing a MUC1* or MUC1 positive cancer is treated with an effective amount of human or humanized MN-E6 scFv-Fc mutant$_{Y407R-Dhinge}$, MN-C2 scFv-Fc mutant$_{Y407R-Dhinge}$, MN-C3 scFv-Fc mutant$_{Y407R-Dhinge}$, or MN-C8 scFv-Fc mutant$_{Y407R-Dhinge}$. One aspect of the invention is a method for treating a patient diagnosed with, suspected of having, or at risk of developing a MUC1 positive or MUC1* positive cancer, wherein the patient is administered an effective amount of a monomeric MN-E6 scFv, MN-C2 scFv, MN-C3 scFv, MN-C8 scFv, or MN-E6 scFv-Fc, MN-C2 scFv-Fc, MN-C3 scFv-Fc, MN-C8 scFv-Fc, wherein the Fc portion of the antibody-like protein has been mutated such that it resists dimer formation.

Humanizing

Humanized antibodies or antibody fragments or fully human antibodies that bind to the extracellular domain of-MUC1* are preferred for therapeutic use. The techniques described herein for humanizing antibodies are but a few of a variety of methods known to those skilled in the art. The invention is not meant to be limited by the technique used to humanize the antibody.

Humanization is the process of replacing the non-human regions of a therapeutic antibody (usually mouse monoclonal antibody) by human one without changing its binding specificity and affinity. The main goal of humanization is to reduce immunogenicity of the therapeutic monoclonal antibody when administered to human. Three distinct types of humanization are possible. First, a chimeric antibody is made by replacing the non-human constant region of the antibody by the human constant region. Such antibody will contain the mouse Fab region and will contain about 80-90% of human sequence. Second, a humanized antibody is made by grafting of the mouse CDR regions (responsible of the binding specificity) onto the variable region of a human antibody, replacing the human CDR (CDR-grafting method). Such antibody will contain about 90-95% of human sequence. Third and last, a full human antibody (100% human sequence) can be created by phage display, where a library of human antibodies is screened to select antigen specific human antibody or by immunizing transgenic mice expressing human antibody.

A general technique for humanizing an antibody is practiced approximately as follows. Monoclonal antibodies are generated in a host animal, typically in mice. Monoclonal antibodies are then screened for affinity and specificity of binding to the target. Once a monoclonal antibody that has the desired effect and desired characteristics is identified, it is sequenced. The sequence of the animal-generated antibody is then aligned with the sequences of many human antibodies in order to find human antibodies with sequences that are the most homologous to the animal antibody. Biochemistry techniques are employed to paste together the human antibody sequences and the animal antibody sequences. Typically, the non-human CDRs are grafted into the human antibodies that have the highest homology to the non-human antibody. This process can generate many candidate humanized antibodies that need to be tested to identify which antibody or antibodies has the desired affinity and specificity.

Once a human antibody or a humanized antibody has been generated it can be further modified for use as an Fab fragment, as a full antibody, or as an antibody-like entity such as a single chain molecule containing the variable regions, such as scFv or an scFv-Fc. In some cases it is desirable to have Fc region of the antibody or antibody-like molecule mutated such that it does not dimerize.

In addition to methods that introduce human sequences into antibodies generated in non-human species, fully human antibodies can be obtained by screening human antibody libraries with a peptide fragment of an antigen. A fully human antibody that functions like MN-E6 or MN-C2 is generated by screening a human antibody library with a peptide having the sequence of the PSMGFR N-10 peptide. A fully human antibody that functions like MN-C3 or MN-C8 is generated by screening a human antibody library with a peptide having the sequence of the PSMGFR C-10 peptide.

Humanized anti-MUC1* antibodies were generated based on the sequences of the mouse monoclonal antibodies MN-E6, MN-C2, MN-C3 and MN-C8. In one aspect of the invention, a patient diagnosed with a MUC1* positive cancer is treated with an effective amount of humanized MN-E6, MN-C2, MN-C3 or MN-C8. In a preferred embodiment, a patient diagnosed with a MUC1* positive cancer is treated with an effective amount of humanized MN-E6 or MN-C2. In another aspect of the invention, a patient diagnosed with a MUC1* positive cancer is treated with an effective amount of humanized monovalent MN-E6, MN-C2, MN-C3 or MN-C8, wherein monovalent means the corresponding Fab fragment, the corresponding scFv or the corresponding scFv-Fc fusion. In a preferred embodiment, a patient diagnosed with a MUC1* positive cancer is treated with an effective amount of a humanized scFv or monomeric humanized scFv-Fc of MN-E6 or MN-C2. Since the MUC1* growth factor receptor is activated by ligand induced dimerization of its extracellular domain, and because the Fc portion of an antibody homo-dimerizes, it is preferable that a construct that includes an Fc portion uses a mutated Fc region that prevents or minimizes dimerization.

Antibodies that bind to PSMGFR (SEQ ID NO:2) peptide of the extracellular domain of the MUC1* receptor are potent anti-cancer therapeutics that are effective for the treatment or prevention of MUC1* positive cancers. They have been shown to inhibit the binding of activating ligands dimeric NME1 (SEQ ID NOS: 3 and 4) and NME7 (SEQ ID NOS: 5 and 6) to the extracellular domain of MUC1*. Anti-MUC1* antibodies that bind to the PSMGFR sequence inhibit the growth of MUC1*-positive cancer cells, specifically if they inhibit ligand-induced receptor dimerization. Fabs of anti-MUC1* antibodies have been demonstrated to block tumor growth in animals. Thus, antibodies or antibody fragments that bind to the extracellular domain of MUC1* would be beneficial for the treatment of cancers wherein the cancerous tissues express MUC1*.

Antibodies that bind to PSMGFR region of MUC1* or bind to a synthetic PSMGFR peptide are preferred. We have identified several monoclonal antibodies that bind to the extracellular domain of MUC1*. Among this group are mouse monoclonal antibodies MN-E6, MN-C2, MN-C3 and MN-C8, the variable regions of which were sequenced and are given as for MN-E6 SEQ ID NOS: 12-13 and 65-66, for MN-C2 SEQ ID NOS: 118-119 and 168-169, for MN-C3 SEQ ID NOS: 413-414 and 458-459 and for MN-C8 SEQ ID NOS: 505-506 and 543-554. The CDRs of these antibodies make up the recognition units of the antibodies and are the most important parts of the mouse antibody that should be retained when grafting into a human antibody. The sequences of the CDRs for each mouse monoclonal are as follows, heavy chain sequence followed by light chain: MN-E6 CDR1 (SEQ ID NO:16-17 and 69-70) CDR2 (SEQ ID NO:20-21 and 73-74) CDR3 (SEQ ID NO: 24-25 and 77-78), MN-C2 CDR1 (SEQ ID NO:122-123 and 172-173) CDR2 (SEQ ID NO:126-127 and 176-177) CDR3 (SEQ ID NO:130-131 and 180-181), MN-C3 CDR1 (SEQ ID NO:417-418 and 462-463) CDR2 (SEQ ID NO:421-422 and 466-467) CDR3 (SEQ ID NO:425-426 and 470-471), MN-C8 CDR1 (SEQ ID NO:507-508 and 545-546) CDR2 (SEQ ID NO:509-510 and 547-548) CDR3 (SEQ ID NO:511-512 and 549-550). In some cases, portions of the framework regions that by modeling are thought to be important for the 3-dimensional structure of the CDRs, are also imported from the mouse sequence.

Monoclonal antibodies MN-E6 and MN-C2 have greater affinity for MUC1* as it appears on cancer cells. Monoclonal antibodies MN-C3 and MN-C8 have greater affinity for MUC1* as it appears on stem cells. By sequence alignment the following human antibodies were chosen as being sufficiently homologous to the mouse antibody that substitution of the mouse CDRs would result in an antibody that retained ability to recognize the target. Mouse MN-E6 heavy chain variable region was homologous to human IGHV3-21*03 heavy chain variable region (SEQ ID NO: 26-27) and the light chain variable region was homologous to human IGKV3-11*02 light chain variable region (SEQ ID NO: 79-80). Mouse MN-C2 heavy chain variable region was homologous to human IGHV3-21*04 heavy chain variable region (SEQ ID NO: 132-133) and the light chain variable region was homologous to human IGKV7-3*01 light chain variable region (SEQ ID NO: 182-183). Mouse MN-C3 heavy chain variable region was homologous to human IGHV1-18*04 heavy chain variable region (SEQ ID NO: 427-428) and the light chain variable region was homologous to human IGKV2-29*03 light chain variable region (SEQ ID NO:472-473). Mouse MN-C8 heavy chain variable region was homologous to human IGHV3-21*04 heavy chain variable region (SEQ ID NO: 513-514) and the light chain variable region was homologous to human Z00023 light chain variable region (SEQ ID NO:551-552).

All four antibodies have been humanized, which process has resulted in several humanized forms of each antibody. CDRs derived from the variable regions of the mouse antibodies were biochemically grafted into a homologous human antibody variable region sequence. Humanized variable regions of MN-E6 (SEQ ID NOS: 38-39 and 93-94), MN-C2 (SEQ ID NOS: 144-145 and 194-195), MN-C3 (SEQ ID NOS: 439-440 and 486-487) and MN-C8 (SEQ ID NOS: 525-526 and 543-544) were generated by grafting the mouse CDRs into the variable region of a homologous human antibody. The humanized heavy chain variable constructs were then fused into constant regions of either human IgG1 heavy chain constant region (SEQ ID NOS:58-59) or human IgG2 heavy chain constant region (SEQ ID NO:54-55), which are then paired with either humanized light chain variable constructs fused to a human kappa chain (SEQ ID NO: 109-110) or human lambda chain (SEQ ID NO: 113-114) constant region. Other IgG isotypes could be used as constant region including IgG3 or IgG4.

Examples of humanized MN-E6 variable region into an IgG2 heavy chain (SEQ ID NOS:52-53) and into an IgG1 heavy chain (SEQ ID NOS:56-57), humanized MN-C2 variable into an IgG1 heavy chain (SEQ ID NOS: 158-159) or into an IgG2 heavy chain (SEQ ID NOS: 163-164) paired with either Lambda light chain (SEQ ID NO: 111-112 and 216-219) or Kappa chain (SEQ ID NO:107-108 and 210-213) and, humanized MN-C3 (SEQ ID NOS: 455-456, 453-454 and 500-501, 502-503) and MN-C8 (SEQ ID NOS: 541-542, 539-540 and 579-580, 581-582) antibodies were generated. Which IgG constant region is fused to the humanized variable region depends on the desired effect since each isotype has its own characteristic activity. The isotype of the human constant region is selected on the basis of things such as whether antibody dependent cell cytotoxicity (ADCC) or complement dependent cytotoxicity (CDC) is desired but can also depend on the yield of antibody that is generated in cell-based protein expression systems. In a preferred embodiment, humanized anti-MUC1* antibodies or antibody fragments are administered to a person diagnosed with or at risk of developing a MUC1-positive cancer.

One method for testing and selecting the humanized anti-MUC1* antibodies that would be most useful for the treatment of persons with cancer or at risk of developing cancers is to test them for their ability to inhibit the binding of activating ligands to the MUC1* extracellular domain. Dimeric NME1 can bind to and dimerize the MUC1* extracellular domain and in so doing stimulates cancer cell growth. Antibodies and antibody fragments that compete with NME1 for binding to the MUC1* extracellular domain are therefore anti-cancer agents. NME7 is another activating ligand of MUC1*. In some cases, it is preferable to identify antibodies that block the binding of NME7, or an NME7 truncation or cleavage product, to the MUC1* extracellular domain. Antibodies and antibody fragments that compete with NME7 and NME7 variants for binding to the MUC1* extracellular domain are effective as anti-cancer therapeutics. These antibodies include but are not limited to MN-E6, MN-C2, MN-C3, MN-C8 as well as single chain versions, such as scFv, of these antibodies and humanized version thereof. Other NME proteins also bind to MUC1 or MUC1* including NME6 and NME8. Antibodies that compete with these proteins for binding to MUC1* may also be useful as therapeutics. In a preferred embodiment, humanized anti-MUC1* antibodies or antibody fragments are administered to a person diagnosed with or at risk of developing a MUC1-positive cancer. In a more preferred embodiment, single chain antibody fragments, or monomeric scFv-Fc fusions, derived from humanized sequences of MN-E6 and MN-C2 are administered to a person diagnosed with or at risk of developing a MUC1-positive cancer.

Single chain variable fragments, scFv, or other forms that result in a monovalent antibody or antibody-like protein are also useful. In some cases it is desired to prevent dimerization of the MUC1* extracellular domain. Single chain variable fragments, Fabs and other monovalent antibody-like proteins have been shown to be effective in binding to the extracellular domain of MUC1* and blocking MUC1* dimerization. These single chain variable fragments, Fabs and other monovalent antibody-like molecules effectively blocked cancer growth in vitro and in animals xenografted with human MUC1-positive cancer cells. Thus, humanized single chain variable fragments or monovalent anti-MUC1* antibodies or antibody-like molecules would be very effective as an anti-cancer therapeutic. Such humanized single chain antibodies, Fabs and other monovalent antibody-like molecules that bind to the MUC1* extracellular domain or to a PSMGFR peptide are therefore useful as anti-cancer therapeutics. Anti-MUC1* single chain variable fragments are generated by grafting non-human CDRs of antibodies, which bind to extracellular domain of MUC1* or bind to PSMGFR peptide, into a framework of a homologous variable region human antibody. The resultant humanized heavy and light chain variable regions are then connected to each other via a suitable linker, wherein the linker should be flexible and of length that it allows heavy chain binding to light chain but discourages heavy chain of one molecule binding to the light chain of another. For example a linker of about 10-15 residues. Preferably, the linker includes [(Glycine)$_4$ (Serine)$_1$]$_3$ (SEQ ID NOS: 401-402), but is not limited to this sequence as other sequences are possible.

In one aspect, the humanized variable regions of MN-E6 (SEQ ID NOS: 38-39 and 93-94), MN-C2 (SEQ ID NOS: 144-145 and 194-195), MN-C3 (SEQ ID NOS: 439-440 and 486-487) and MN-C8 (SEQ ID NOS: 525-526 and 565-566) are biochemically grafted into a construct that connects heavy and light chains via a linker. Examples of humanized single chain anti-MUC1* antibodies comprising humanized sequences from the variable regions of MN-E6, MN-C2, MN-C3 and MN-C8 were generated. Several humanized MN-E6 single chain proteins were generated (SEQ ID NOS: 232-237). Several humanized MN-C2 single chain proteins were generated (SEQ ID NOS: 238-243). Several humanized MN-C3 single chain proteins were generated (SEQ ID NOS: 244-249). Several humanized MN-C8 single chain proteins were generated (SEQ ID NOS: 250-255). In a preferred embodiment, humanized anti-MUC1* antibody fragments, including variable fragments, scFv antibody fragments MN-E6 scFv, MN-C2 scFv, MN-C3 scFv, or MN-C8 scFv are administered to a person diagnosed with or at risk of developing a MUC1-positive cancer. In a more preferred embodiment, single chain antibody fragments, such as variable fragments derived from humanized sequences of MN-E6 and MN-C2, are administered to a person diagnosed with or at risk of developing a MUC1-positive cancer.

In another aspect, the humanized variable regions of MN-E6 (SEQ ID NOS: 38-39 and 93-94), MN-C2 (SEQ ID NOS: 144-145 and 194-195), MN-C3 (SEQ ID NOS: 439-440 and 486-487) and MN-C8 (SEQ ID NOS: 525-526 and 565-566) are biochemically grafted into a single chain variable fragment, scFv, that also contains an Fc portion of an antibody. Examples of humanized single chain variable fragment of MN-E6, MN-C2, MN-C3 and MN-C8 fused to a Fc region of an antibody were generated (SEQ ID NOS: 256-257, 260-261, 264-265 and 268-269). Inclusion of an Fc region serves several purposes. It increases the molecular weight of the antibody fragment, which slows degradation and increases half-life. An Fc region also recruits immune system complement to the tumor site. Additionally, the addition of an antibody Fc region makes the scFv a convenient diagnostic tool, as the secondary antibodies detect and label the Fc portion. However, the Fc portion homo-dimerizes. Thus an scFv-Fc would be bivalent and could dimerize and activate the MUC1* growth factor receptor. In order to get the benefits of having an Fc attached to an anti-MUC1* scFv, without the drawback of inducing MUC1* dimerization, the Fc region was mutated to minimize or eliminate Fc homo-dimerization. The following mutations were made in the CH3 domain to create a monomeric scFv-Fc fusion protein: Y407R (SEQ ID NOS: 278 and 279), F405Q (SEQ ID NOS: 280 and 281), T394D (SEQ ID NOS: 282 and 283), T366W/L368W (SEQ ID NOD: 284 and 285), T364R/L368R (SEQ ID NOS: 286 and 285). Any combinations of those mutations can be tested and could be introduced into Fc (SEQ ID NOS: 272-273), CH2-CH3 (SEQ ID NOS: 274-275) or CH3 (SEQ ID NOS: 276-277) fusion proteins or in the hingeless Fc-fusion proteins (SEQ ID NOS: 288-289).

One aspect of the invention is a method for treating a patient diagnosed with, suspected of having, or at risk of developing a MUC1 positive or MUC1* positive cancer, wherein the patient is administered an effective amount of a monomeric MN-E6 scFv, MN-C2 scFv, MN-C3 scFv, MN-C8 scFv, or MN-E6 scFv-Fc, MN-C2 scFv-Fc, MN-C3 scFv-Fc, MN-C8 scFv-Fc, wherein the antibody variable fragment portions are human or have been humanized and wherein the Fc portion of the antibody-like protein has been mutated such that it resists dimer formation.

CAR T and Cancer Immuno Therapy Techniques

In another aspect of the invention, some or all of the single chain portions of anti-MUC1* antibody fragments are biochemically fused onto immune system molecules, using several different chimeric antigen receptor, 'CAR' strategies. The idea is to fuse the recognition portion of an antibody, typically as a single chain variable fragment, to an immune system molecule that has a transmembrane domain and a cytoplasmic tail that is able to transmit signals that activate the immune system. The recognition unit can be an antibody fragment, a single chain variable fragment, scFv, or a peptide. In one aspect, the recognition portion of the extracellular domain of the CAR is comprised of sequences from the humanized variable region of MN-E6 (SEQ ID NOS: 38-39 and 93-94), MN-C2 (SEQ ID NOS: 144-145 and 194-195), MN-C3 (SEQ ID NOS: 439-440 and 486-487) and MN-C8 (SEQ ID NOS: 525-526 and 565-566). In another aspect, it is comprised of sequences from a single chain variable fragment. Examples of single chain constructs are given. Several humanized MN-E6 single chain proteins, scFv, were generated (SEQ ID NOS: 232-237). Several humanized MN-C2 single chain proteins, scFv, were generated (SEQ ID NOS: 238-243). Several humanized MN-C3 single chain proteins, scFv, were generated (SEQ ID NOS: 244-249). Several humanized MN-C8 single chain proteins, scFv, were generated (SEQ ID NOS: 250-255). The transmembrane region of the CAR can be derived from CD8, CD4, antibody domains or other transmembrane region, including the transmembrane region of the proximal cytoplasmic co-stimulatory domain. The cytoplasmic tail of the CAR can be comprised of one or more motifs that signal immune system activation. This group of cytoplasmic signaling motifs, sometimes referred to as, co-stimulatory cytoplasmic domains, includes but is not limited to CD3-zeta, CD27, CD28, 4-1BB, 0X40, CD30, CD40, PD-1, ICAm-1, LFA-1, ICOS, CD2, CD5, CD7 and Fc receptor gamma domain. A minimal CAR may have the CD3-zeta or an Fc receptor gamma domain then one or two of the above domains in tandem on the cytoplasmic tail. In one aspect, the cytoplasmic tail comprises CD3-zeta, CD28, 4-1BB and/or 0X40. Several examples of humanized MN-E6 CARs were generated: CAR MN-E6 CD3z (SEQ ID NOS: 294-295); CAR MN-E6 CD28/CD3z (SEQ ID NOS: 297-298); CAR MN-E6 4-1BB/CD3z (SEQ ID NOS: 300-301); CAR MN-E6 0X40/CD3z (SEQ ID NOS: 616-617); CAR MN-E6 CD28/0X40/CD3z (SEQ ID NOS: 618-619); CAR MN-E6 CD28/4-1BB/CD3z (SEQ ID NOS: 303-304). Several examples of humanized MN-C2 CARs were generated: CAR MN-C2 CD3z (SEQ ID NOS: 606-607); CAR MN-C2 CD28/CD3z (SEQ ID NOS: 608-609); CAR MN-C2 4-1BB/CD3z (SEQ ID NOS: 610-611); CAR MN-C2 0X40/CD3z (SEQ ID NOS: 612-613); CAR MN-C2 CD28/4-1BB/CD3z (SEQ ID NOS: 306-307); CAR MN-C2 CD28/0X40/CD3z (SEQ ID NOS: 614-615). Humanized MN-C3 CAR was generated: CAR MN-C3 4-1BB/CD3z (SEQ ID NOS: 600-601).

Several examples of humanized MN-E6 CARs with different hinge regions (SEQ ID NOS:345-360) were generated: CAR MN-E6-Fc/8/41BB/CD3z (SEQ ID NOS:310-311); CAR MN-E6 FcH/8/41BB/CD3z (SEQ ID NOS:315-316); CAR MN-E6 Fc/4/41BB/CD3z (SEQ ID NOS:318-319); CAR MN-E6 FcH/4/41BB/CD3z (SEQ ID NOS:321-322);; CAR MN-E6 IgD/8/41BB/CD3z (SEQ ID NOS:323-324); CAR MN-E6 IgD/4/41BB/CD3z (SEQ ID NOS:327-328); CAR MN-E6 X4/8/41BB/CD3z (SEQ ID NOS:330-331); CAR MN-E6 X4/4/41BB/CD3z (SEQ ID NOS:333-334); CAR MN-E6 8+4/4/41BB/CD3z (SEQ ID NOS:336-337). In addition, several humanized MN-C3 single chain variable fragment and humanized MN-C8 single chain variable fragments were also generated.

The extracellular domain recognition unit of a MUC1* targeting CAR can comprise the variable regions of humanized MN-E6, MN-C2, MN-C3 or MN-C8 or other antibody that binds to the PSMGFR portion of MUC1* or a PSMGFR peptide. In one aspect, the extracellular domain recognition unit of a CAR is comprised essentially of a humanized MN-E6, MN-C2, MN-C3 or MN-C8 single chain variable fragment scFv. The transmembrane region of the CAR can be derived from CD8 (SEQ ID NOS:363-364), or can be the transmembrane domain of CD3-zeta, CD28, 41bb, 0X40 or other transmembrane region (SEQ ID NOS:361-372) and the cytoplasmic domain of a CAR with antibody fragment targeting MUC1* extracellular domain can be comprised of one or more selected from the group comprising an immune system co-stimulatory cytoplasmic domain. The group of immune system co-stimulatory domains includes but is not limited to CD3-zeta, CD27, CD28, 4-1BB, OX40, CD30, CD40, PD-1, ICAm-1, LFA-1, ICOS, CD2, CD5, CD7 and Fc receptor gamma domain (SEQ ID NOS:373-382). Alternatively, the recognition unit portion of a CAR can comprise a peptide wherein the peptide binds to the target. NME7 binds to and activates MUC1*. In one aspect of the invention, the recognition unit of a CAR is a peptide derived from NME7 (SEQ ID NOS: 5-6) or a peptide derived from NME7, including but not limited to NME7 peptide A1 (SEQ ID NO: 7), NME7 peptide A2 (SEQ ID NO: 8), NME7 peptide B1 (SEQ ID NO: 9), NME7 peptide B2 (SEQ ID NO: 10) and NME7 peptide B3 (SEQ ID NO: 11).

Some strategies for generating CARs include a portion of the molecule that dimerizes with itself. In some cases, dimerization of the target is not desirable. Therefore CARs can be constructed such that they heterodimerize. In one case the recognition unit of the first CAR binds to a first target while the recognition unit of the second CAR binds to a second target. Both recognition units can be antibody fragments, both can be peptides or one can be an antibody fragment and the other a peptide. A first target of the CAR can be the extracellular domain of MUC1*. The recognition unit of the CAR would be comprised of an antibody fragment that binds to MUC1* extracellular domain or to a PSMGFR peptide. Alternatively, the recognition unit of the CAR would be comprised of a peptide that binds to MUC1* extracellular domain, such peptides include peptides derived from an NME protein such as NME1 or NME7, more particularly NME7 derived peptides listed as SEQ ID NOS: 7-11. A second target of a heterodimeric CAR may be a peptide or antibody fragment that binds to NME7. Alternatively, a second target of a heterodimeric CAR may be a peptide or antibody fragment that binds to PD1 or other target on a MUC1*-presenting cell. A second target may be a peptide or antibody fragment that binds to NME1. Because it is desirable to prevent dimerization of MUC1 induced by a CAR, heterodimeric CARs can be constructed so that only the extracellular domain of one molecule has an extracellular recognition unit that binds to a target (SEQ ID NOS: 584-587). The other molecule can have a truncated extracellular domain that is devoid of a target recognition unit or antibody fragment (SEQ ID NOS:588-599). The CARs described can be transfected or transduced into a cell of the immune system. In a preferred embodiment, a MUC1* targeting CAR is transfected or transduced into a T cell. In one aspect the T cell is a CD3+/CD28+T cell. In another case it is a dendritic cell. In another case it is a B cell. In another case it is a mast cell. The recipient cell can be from a patient or from a donor. If from a donor, it can be engineered to remove molecules that would trigger rejection. Cells transfected or transduced with a CAR of the invention can be expanded ex vivo or in vitro then administered to a patient. Administrative routes are chosen from a group containing but not limited to bone marrow transplant, intravenous injection, in situ injection or transplant. In a preferred embodiment, the MUC1* targeting CAR is administered to a person diagnosed with or at risk of developing a MUC1-positive cancer.

There are many possible anti-MUC1* CAR constructs that can be transduced into T cells or other immune cells for the treatment or prevention of MUC1* positive cancers. CARs are made up of modules and the identity of some of the modules is relatively unimportant, while the identity of other modules is critically important.

Figure 28:
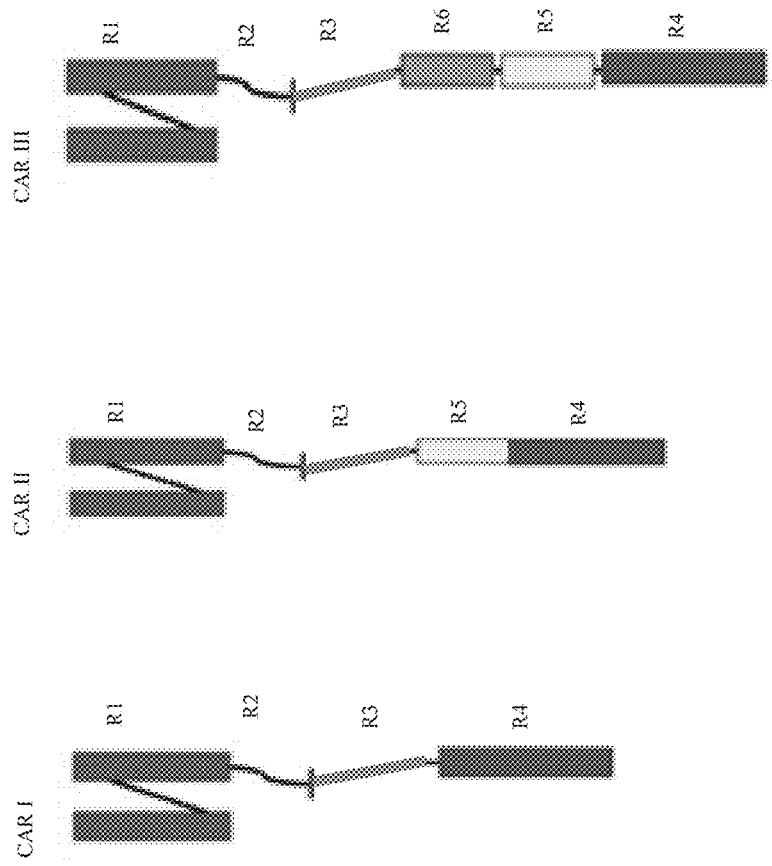
FIG. 28 shows schematics of CAR sequence components.

Our experiments demonstrate that the antibody recognition fragment at the outermost portion of the CAR is critically important because it targets the immune cell bearing the CAR to the tumor site. The intracellular signaling motifs are also very important but can be interchanged. FIG. 28 shows a schematic of the components of CAR and the various sequences that may be included in a CAR. Referring to FIG. 28, R1 is: nothing; or a ligand or a fragment of a ligand of a cancer associated antigen; or a ligand or a fragment of a ligand of MUC1 or MUC1*; or an antibody or antibody fragment wherein the antibody or antibody fragment binds to MUC1 or MUC1*; or an antibody or antibody fragment wherein the antibody or antibody fragment binds to PSMGFR*, wherein the antibody may be human or humanized; or an antibody or antibody fragment of MN-E6, MN-C2, MN-C3 or MN-C8 or humanized MN-E6, MN-C2, MN-C3 or MN-C8; or a single chain variable fragment of an antibody, scFv, that binds to a cleaved MUC1 or MUC1*; or a scFv of MN-E6, MN-C2, MN-C3 or MN-C8, which may be humanized; or a peptide that binds to MUC1* or PSMGFR peptide; or is an antibody fragment, a scFv, or a peptide that binds the PSMGFR portion of MUC1*; or is comprised of sequence from the humanized variable region of MN-E6 (SEQ ID NOS: 38-39 and 93-94), MN-C2 (SEQ ID NOS: 144-145 and 194-195), MN-C3 (SEQ ID NOS: 439-440 and 486-487) and MN-C8 (SEQ ID NOS: 525-526 and 565-566). In one aspect R1 is a scFv that binds the PSMGFR portion of MUC1* comprised of sequence from humanized MN-E6 scFv (SEQ ID NOS: 232-237), humanized MN-C2 scFv (SEQ ID NOS: 238-243), humanized MN-C3 scFv (SEQ ID NOS: 244-249) or humanized MN-C8 scFv (SEQ ID NOS: 250-255). In another aspect R1 is a scFv that binds the PSMGFR portion of MUC1* comprised of sequence from humanized MN-E6 scFv (SEQ ID NOS: 232-237) or humanized MN-C2 scFv (SEQ ID NOS: 238-243). In one example R1 is a scFv that binds the PSMGFR portion of MUC1* comprised of sequence from humanized MN-E6 scFv (SEQ ID NOS: 232-237)

R2 is a polypeptide flexible linker that connects the recognition portion to the transmembrane domain of the CAR. In one aspect, R2 can be a polypeptide linker of different length from 5 to 250 amino acids. In another aspect, R2 is a polypeptide linker of human origin. In one aspect R2 can be made of or a modification of the Fc region of a human immunoglobulin (IgG, IgA, IgE, IgM or IgD). I another aspect, R2 can be the hinge region or a modification of the hinge region of a human immunoglobulin (IgG, IgA, IgE, IgM or IgD). In one aspect, R2 can be the hinge region or a modification of the hinge region of a T-cell receptor (CD8a, CD28 or CD4). In one example, R2 is the hinge region of CD8a, the hinge region of human IgD or the Fc domain of human IgG1.

R3 is a transmembrane domain. In one aspect, R3 can be a transmembrane domain or a modification of a transmembrane domain of any transmembrane human proteins. In another aspect, R3 can be a transmembrane domain or a modification of a transmembrane domain from human cell receptor. In one aspect, R3 can be a transmembrane domain or a modification of a transmembrane domain of a T-cell receptor (CD8a, CD4, CD28, CD3z, OX40 or 41-BB). In another aspect, R3 is a transmembrane domain from the first cytoplasmic co-stimulatory domain of the CAR. In one aspect, R3 can be a transmembrane domain or a modification of a transmembrane domain of a T-cell receptor extended with 1,2,3,4 or 5 amino acids of the cytoplasmic domain associated to the transmembrane domain. In another aspect, R3 can be a transmembrane domain or a modification of a transmembrane domain of a T-cell receptor extended with 1,2,3,4 or five amino acids of the cytoplasmic domain associated to the transmembrane domain followed by a cystein for disulfide bond formation. In one example, R3 is the transmembrane domain of CD8a or CD4.

R4 is a signaling domain from a T-cell receptor. In one aspect, R4 can be the cytoplasmic signaling domain of CD3-zeta, CD27, CD28, 4-1BB, OX40, CD30, CD40, PD-1, ICAm-1, LFA-1, ICOS, CD2, CDS, CD7 and Fc receptor gamma domain. In one example, R4 is the cytoplasmic domain of CD3-zeta. Several examples of humanized CAR with single signaling domain (CAR I) were regenerated: CAR MN-E6 CD3z (SEQ ID NOS: 294-295); CAR MN-C2 CD3z (SEQ ID NOS: 606-607)

R5 is a co-stimulatory domain from a T-cell receptor. In one aspect, R5 can be the cytoplasmic signaling domain of CD27, CD28, 4-1BB, OX40, CD30, CD40, PD-1, ICAm-1, LFA-1, ICOS, CD2, CDS, CD7 and Fc receptor gamma domain. R5 will be different from R4 and R6. In one example, R5 is the cytoplasmic domain of CD28, 4-1BB or OX40. Several examples of humanized CAR with two signaling domain (CAR II) were regenerated: CAR MN-E6 CD28/CD3z (SEQ ID NOS: 297-298); CAR MN-E6 4-1BB/CD3z (SEQ ID NOS: 300-301); CAR MN-E6 0X40/CD3z (SEQ ID NOS: 616-617); CAR MN-C2 CD28/CD3z (SEQ ID NOS: 608-609); CAR MN-C2 4-1BB/CD3z (SEQ ID NOS: 610-611); CAR MN-C2 0X40/CD3z (SEQ ID NOS: 612-613); MN-C3 4-1BB/CD3z (SEQ ID NOS: 600-601); CAR MN-E6-Fc/8/41BB/CD3z (SEQ ID NOS:310-311); CAR MN-E6 FcH/8/41BB/CD3z (SEQ ID NOS:315-316); CAR MN-E6 Fc/4/41BB/CD3z (SEQ ID NOS:318-319); CAR MN-E6 FcH/4/41BB/CD3z (SEQ ID NOS:321-322);; CAR MN-E6 IgD/8/41BB/CD3z (SEQ ID NOS:323-324); CAR MN-E6 IgD/4/41BB/CD3z (SEQ ID NOS:327-328); CAR MN-E6 X4/8/41BB/CD3z (SEQ ID NOS:330-331); CAR MN-E6 X4/4/41BB/CD3z (SEQ ID NOS:333-334); CAR MN-E6 8+4/4/41BB/CD3z (SEQ ID NOS:336-337).

R6 is a co-stimulatory domain from a T-cell receptor. In one aspect, R6 can be the cytoplasmic signaling domain of CD27, CD28, 4-1BB, 0X40, CD30, CD40, PD-1, ICAm-1, LFA-1, ICOS, CD2, CD5, CD7 and Fc receptor gamma domain. R6 will be different from R4 and R5. In one example, R5 is the cytoplasmic domain of CD28. Several examples of humanized CAR with two signaling domain (CAR III) were regenerated: CAR MN-E6 CD28/0X40/CD3z (SEQ ID NOS: 618-619); CAR MN-E6 CD28/4-1BB/CD3z (SEQ ID NOS: 303-304); CAR MN-C2 CD28/4-1BB/CD3z (SEQ ID NOS: 306-307); CAR MN-C2 CD28/0X40/CD3z (SEQ ID NOS: 614-615)

We and others (Pulé MA, Straathof KC, Dotti G, Heslop HE, Rooney CM and Brenner MK. (2005) A chimeric T cell antigen receptor that augments cytokine release and supports clonal expansion of primary human T cells. Mol Ther. 12(5):933-941; Hombach AA, Heiders J, Foppe M, Chmielewski M and Abken H. (2012) 0X40 costimulation by a chimeric antigen receptor abrogates CD28 and IL-2 induced IL-10 secretion by redirected CD4(+) T cells. Oncoimmunology. 1(4):458-466; Kowolik CM, Topp MS, Gonzalez S, Pfeiffer T, Olivares S, Gonzalez N, Smith DD, Forman SJ, Jensen MC and Cooper LJ. (2006) CD28 costimulation provided through a CD19-specific chimeric antigen receptor enhances in vivo persistence and antitumor efficacy of adoptively transferred T cells. Cancer Res. 66(22):10995-11004; Loskog A, Giandomenico V, Rossig C, Pule M, Dotti G and Brenner MK. (2006) Addition of the CD28 signaling domain to chimeric T-cell receptors enhances chimeric T-cell resistance to T regulatory cells. Leukemia. 20(10):1819-1828; Milone MC, Fish JD, Carpenito C, Carroll RG, Binder GK, Teachey D, Samanta M, Lakhal M, Gloss B, Danet-Desnoyers G, Campana D, Riley JL, Grupp SA and June CH. (2009) Chimeric receptors containing CD137 signal transduction domains mediate enhanced survival of T cells and increased antileukemic efficacy in vivo. Mol Ther. 17(8):1453-1464; Song DG, Ye Q, Carpenito C, Poussin M, Wang LP, Ji C, Figini M, June CH, Coukos G, Powell DJ Jr. (2011) In vivo persistence, tumor localization, and antitumor activity of CAR-engineered T cells is enhanced by costimulatory signaling through CD137 (4-1BB). Cancer Res. 71(13):4617-4627) have shown that intracellular signaling modules, such as CD3-zeta (SEQ ID NOS: 373-376), CD28 (SEQ ID NOS: 377-378) and 41BB (SEQ ID NOS: 379-380), alone or in combinations stimulate immune cell expansion, cytokine secretion and immune cell mediated killing of the targeted tumor cells. Less important is the identity of the short extracellular piece that presents the antibody fragment, the transmembrane domain, and the short cytoplasmic tail that comes before the intracellular signaling motifs.

The identity of the recognition antibody fragment that targets the CAR to a tumor is critically important. For the treatment of MUC1 positive or MUC1* positive cancers, that antibody recognition fragment must bind to the extracellular domain of portion of MUC1 that remains after cleavage and shedding of the bulk of the extracellular domain, which contains the tandem repeat domains. In one aspect of the invention, the portion that remains comprises the PSMGFR sequence. In another aspect of the invention, the portion of MUC1 that remains after cleavage and shedding contains the PSMGFR sequence plus nine (9) more amino acids extended at the N-terminus. In another aspect of the invention, the portion of MUC1 that remains after cleavage and shedding contains the PSMGFR sequence plus twenty one (21) more amino acids extended at the N-terminus. In one aspect the antibody recognition fragment binds to a PSMGFR peptide. In another aspect of the invention, the antibody recognition fragment binds to a peptide comprising the sequence SNIKFRPGSVVVQLTLAFREGTINVHDVETQFNQYKTEAASRY (SEQ ID NO:620); or SVVVQLTLAFREGTINVHDVETQFNQYKTEAASRY (SEQ ID NO:621) As a demonstration, a single chain antibody fragment that included the variable domain of the monoclonal anti-MUC1* antibodies called MN-E6 or MN-C2 were engineered into a panel of CARs. The MUC1* targeting CARs were then transduced, separately or in combinations, into immune cells. When challenged with surfaces presenting a MUC1* peptide, an antigen presenting cell transfected with MUC1*, or MUC1* positive cancer cells, the immune cells that were transduced with MUC1* targeting CARs elicited immune responses, including cytokine release, killing of the targeted cells and expansion of the immune cells. In one case, human jurkat cells were transduced with MUC1*-targeting CARs and upon exposure to a surface presenting the PSMGFR peptide, K562 antigen presenting cells that had been transfected with MUC1* or MUC1* positive cancer cells, the jurkhat cells secreted IL-2. In another case, purified human T cells were transduced with MUC1*-targeting CARs and upon exposure to a surface presenting the PSMGFR peptide, K562 antigen presenting cells that had been transfected with MUC1* or MUC1* positive cancer cells, the T cells secreted IL-2, interferon gamma, and killed the targeted antigen presenting cells and cancer cells, while the T cells expanded. As demonstrated, CARs that comprise an antibody fragment, wherein the antibody fragment is able to bind to the PSMGFR peptide, a transmembrane domain and a cytoplasmic tail bearing co-stimulatory domains, elicit an immune system anti-tumor cell response when said CARs are transduced into immune cells, which include T cells. Therefore, other antibodies, antibody fragments or antibody mimics that are able to bind to the PSMGFR peptide will perform similarly and can be used to treat or prevent cancers. Those skilled in the art will recognize that there are a number of technologies available for transfecting or transducing cells with CARs and the invention is not limited by the method used for making the immune cell express a MUC1*-targeting CAR. For example, retroviruses, adeno viruses, lenti viruses and the like can be used. Similarly, the identity of molecules that make up the non-targeting, portions of the CAR such as the extracellular domain, transmembrane domain and membrane proximal portion of the cytoplasmic domain, are not essential to the function of a MUC1*-targeting CAR. For example, the extracellular domain, transmembrane domain and membrane proximal portion of the cytoplasmic domain can be comprised of portions of CD8, CD4, CD28, or generic antibody domains such as Fc, CH2CH3, or CH3.

Further, the non-targeting portions of a CAR can be a composite of portions of one or more of these molecules or other family members.

One aspect of the invention is a method for treating a patient diagnosed with, suspected of having, or at risk of developing a MUC1 positive or MUC1* positive cancer, wherein the patient is administered an effective amount of immune cells that have been transduced with a MUC1* targeting CAR. In another aspect of the invention, the immune cells are T cells isolated from a patient, which are then transduced with CARs wherein the targeting head of the CAR binds to MUC1*, and after expansion of transduced T cells, the CAR T cells are administered in an effective amount to the patient. In yet another aspect of the invention, the immune cells are T cells isolated from a patient, which are then transduced with CARs wherein the targeting head of the CAR comprises portions of huMN-E6, huMN-C2, huMN-C3 or huMN-C8, and after optional expansion of transduced T cells, the CAR T cells are administered in an effective amount to the patient.

Specifics of CARs Made and Tested

Figure 29:
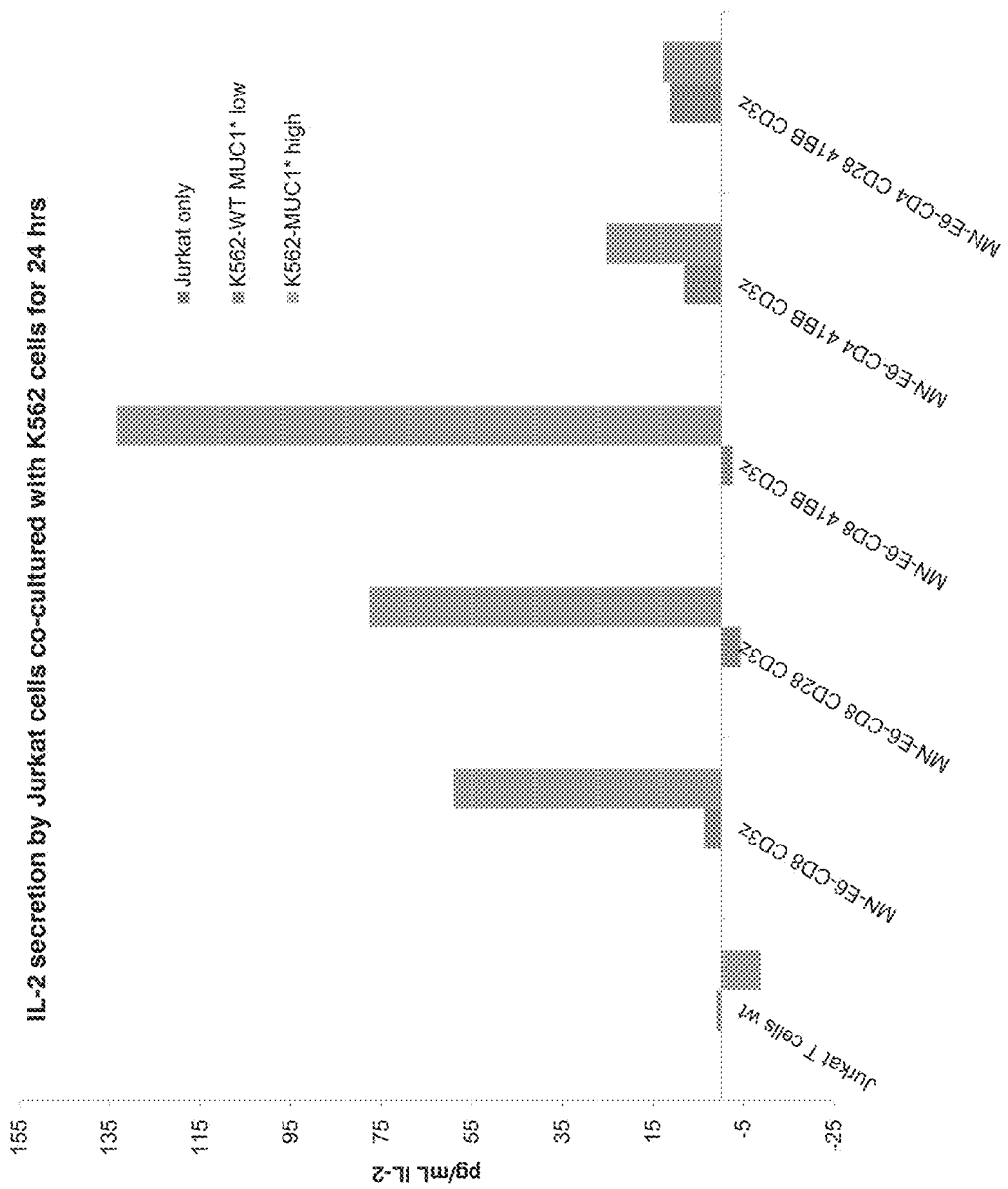
FIG. 29 is a graph of an experiment measuring IL-2 cytokine secretion by Jurkat T cells that were transduced with a panel of CARs, including MN-E6-CD8-3z, MN-E6-CD8-CD28-3z, MN-E6-CD8-41BB-3z, MN-E6-CD4-CD28-3z and MN-E6-CD4-CD28-41BB-3z, when the CAR T cells were exposed to K562-wt cells or K562 cells that had been transfected with MUC1*.
Figure 30:
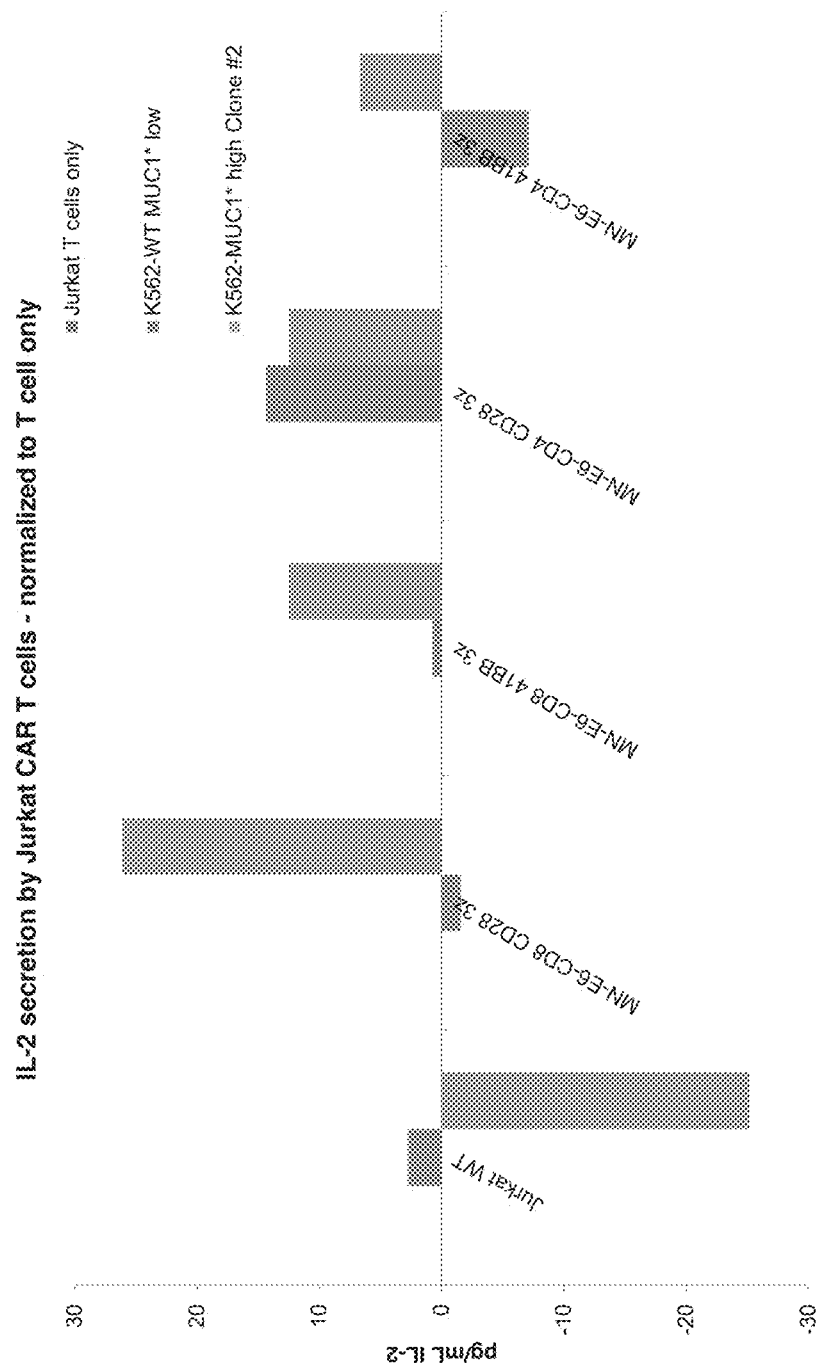
FIG. 30 is a graph of an experiment measuring IL-2 cytokine secretion by Jurkat T cells that were transduced with a panel of CARs, including MN-E6-CD8-CD28-3z, MN-E6-CD8-41BB-3z, MN-E6-CD4-CD28-3z and MN-E6-CD4-41BB-3z, when the CAR T cells were exposed to K562-wt cells or K562 cells that had been transfected with MUC1*.
Figure 31:
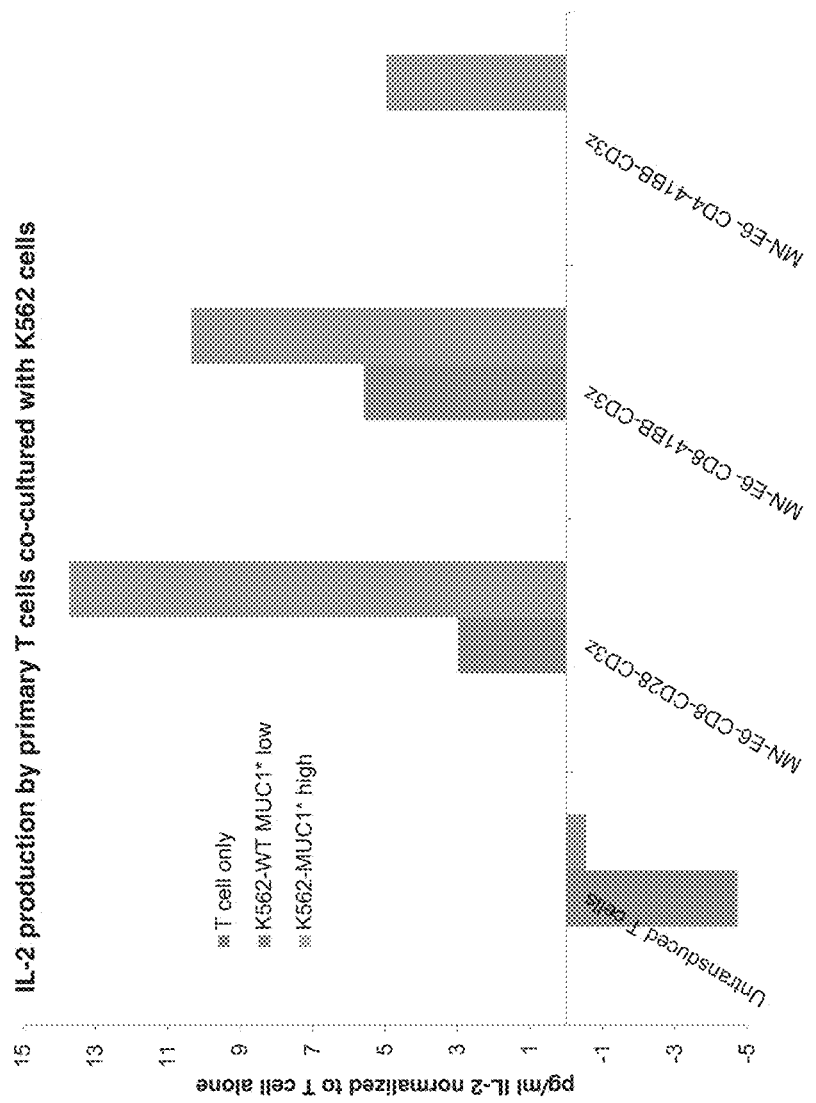
FIG. 31 is a graph of an experiment measuring IL-2 cytokine secretion by primary human T cells, isolated from a blood sample, that were transduced with a panel of CARs, including MN-E6-CD8-CD28-3z, MN-E6-CD8-41BB-3z and MN-E6-CD4-41BB-3z, when the CAR T cells were exposed to K562-wt cells or K562 cells that had been transfected with MUC1*.
Figure 32:
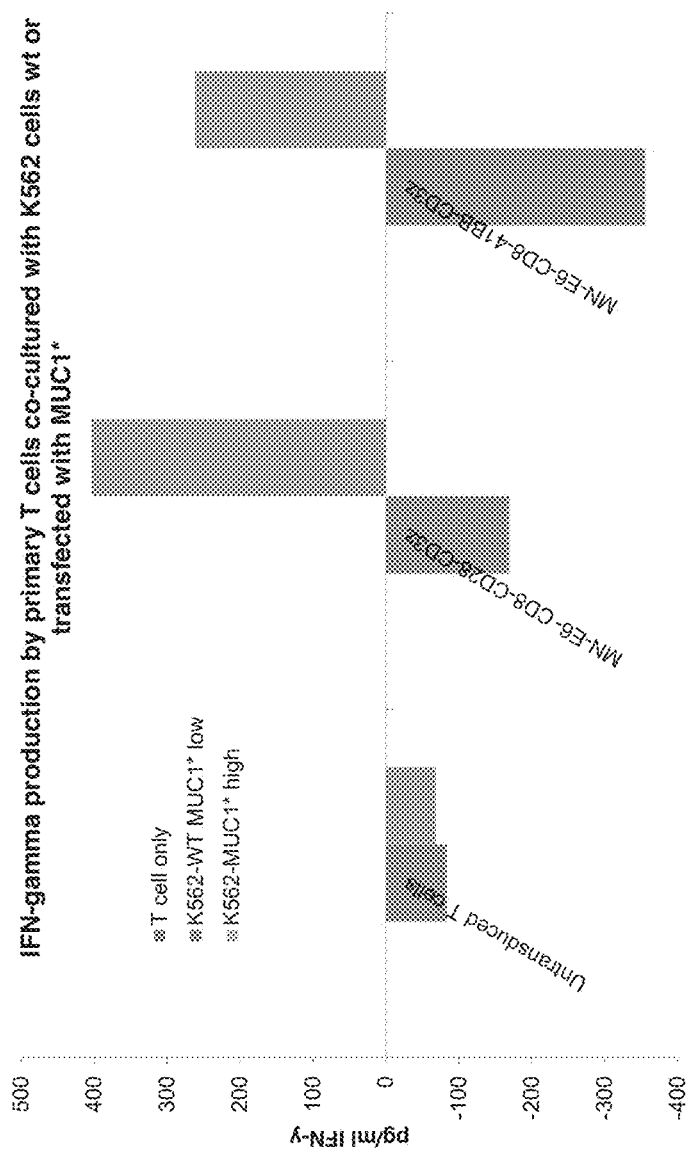
FIG. 32 is a graph of an experiment measuring interferon-gamma (IFN-g) cytokine secretion by primary human T cells, isolated from a blood sample, that were transduced with a panel of CARs, including MN-E6-CD8-CD28-3z and MN-E6-CD4-41BB-3z, when the CAR T cells were exposed to K562-wt cells or K562 cells that had been transfected with MUC1*.
Figure 33:
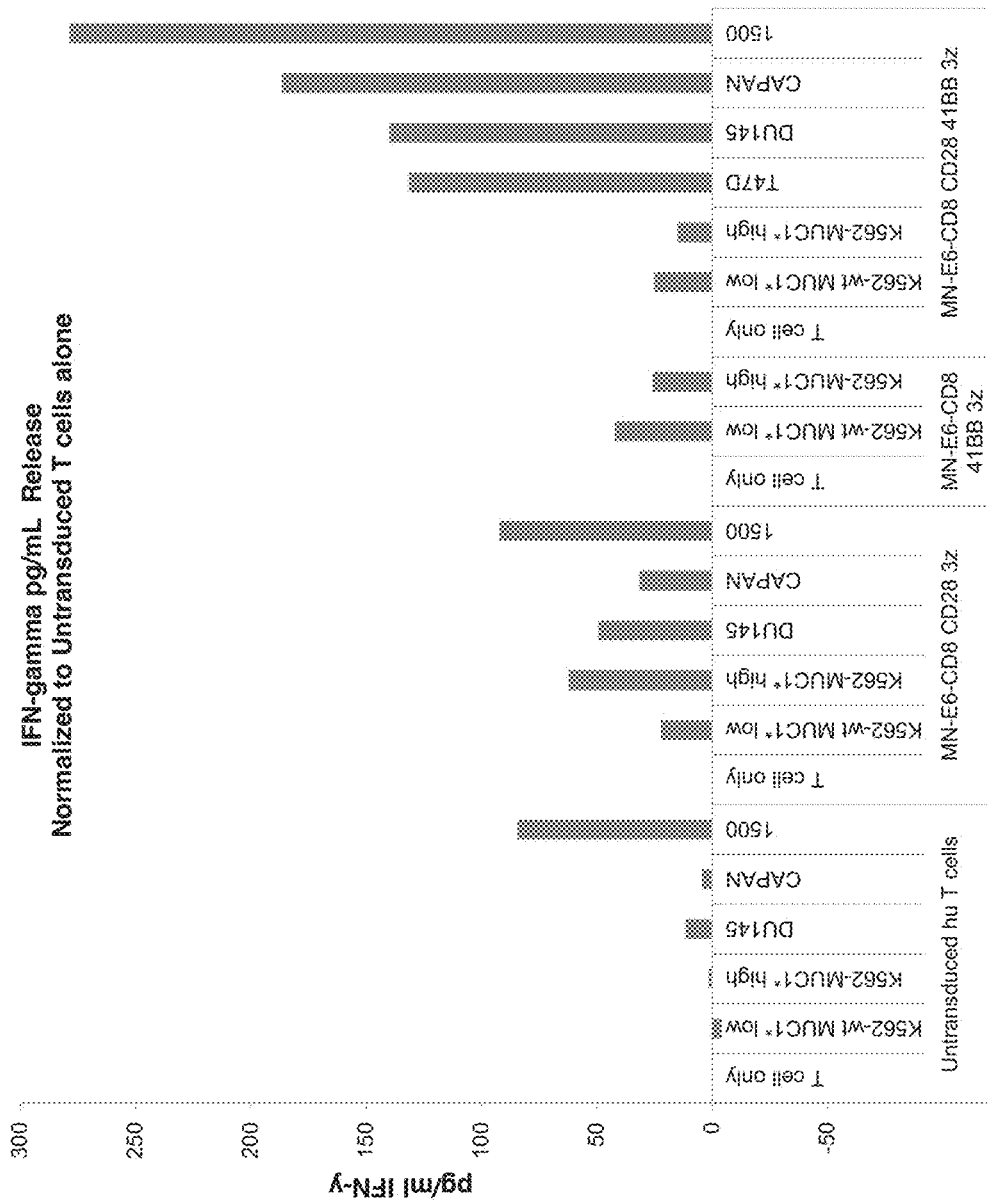
FIG. 33 is a graph of an experiment measuring interferon-gamma (IFN-g) cytokine secretion by primary human T cells, isolated from a blood sample, that were transduced with a panel of CARs, including MN-E6-CD8-CD28-3z, MN-E6-CD8-41BB-3z and MN-E6-CD8-CD28-41BB-3z, when the CAR T cells were exposed to K562-wt cells, K562 cells that had been transfected with MUC1*, or MUC1* positive cancer cells of prostate cancer, breast cancer or pancreatic cancer.

Many MUC1* targeting CARs were generated wherein the targeting antibody fragment at the distal end of the CAR was either MN-E6, MN-C2, MN-C3 or MN-C8. The DNA of each CAR was sequenced to verify that cloning was correctly done. Each construct was then shuffled into an expression plasmid, transfected into cells and then verified that the construct had successfully inserted by Western blot. Surface expression was verified by FACS. The MUC1* targeting CARs were then virally transduced into immune cells. In one aspect they were transduced into Jurkat cells. In another aspect they were transduced into primary human T cells that were purified from blood. A series of functional assays were performed and verified that the CARs were functional. Functional assays showed that both Jurkat cells and primary T cells transduced with MUC1* targeting CAR secreted the cytokine IL-2 when challenged with cells presenting MUC1*. FIG. 29 is a graph of an experiment measuring IL-2 cytokine secretion by Jurkat cells that were transduced with a panel of CARs, including MN-E6 CD8/CD3z, MN-E6 CD8/CD28/CD3z, MN-E6 CD8/41BB/CD3z, MN-E6 CD4/CD28/CD3z and MN-E6 CD4/CD28/41BB/CD3z. IL-2 was secreted only when the CAR Jurkat cells were exposed to K562-wt cells or K562 cells that had been transfected with MUC1*. It should be noted that the parent K562-wt cells express very low levels of MUC1*. Another group of CARs transfected into Jurkat cells was similarly tested for cytokine secretion. FIG. 30 shows IL-2 secretion by Jurkat T cells that were transduced with MN-E6 CD8/CD28/CD3z, MN-E6 CD8/41BB/CD3z, MN-E6 CD4/CD28/CD3z or MN-E6 CD4/41BB/CD3z, when the CAR T cells were exposed to K562-wt cells or K562 cells that had been transfected with MUC1*. Similarly, FIG. 31 shows IL-2 cytokine secretion by primary human T cells that were transduced with MN-E6 CD8/CD28/CD3z, MN-E6 CD8/41BB/CD3z or MN-E6 CD4/41BB/CD3z. Cytokine secretion only occurred when the MUC1* targeting CART cells were exposed to K562-wt cells or K562 cells that had been transfected with MUC1*. Another cytokine that is secreted by activated T cells when they see a target cell is interferon-gamma (IFN-g). FIG. 32 shows that interferon-gamma was secreted by primary human T cells that were transduced with a panel of CARs, including MN-E6 CD8/CD28/CD3z and MN-E6 CD4/41BB/CD3z, when the CAR T cells were exposed to K562-wt cells or K562 cells that had been transfected with MUC1*. Interferon-gamma was similarly secreted by primary human T cells that were transduced with a panel of CARs, including MN-E6 CD8/CD28/CD3z, MN-E6 CD8/41BB/CD3z and MN-E6 CD8/CD28/41BB/CD3z, when the MUC1* targeting CAR T cells were exposed to K562-wt cells, K562 cells that had been transfected with MUC1*, or MUC1* positive cancer cells of prostate cancer (DU145), breast cancer (1500) or pancreatic cancer (Capan) (FIG. 33).

Figure 34:
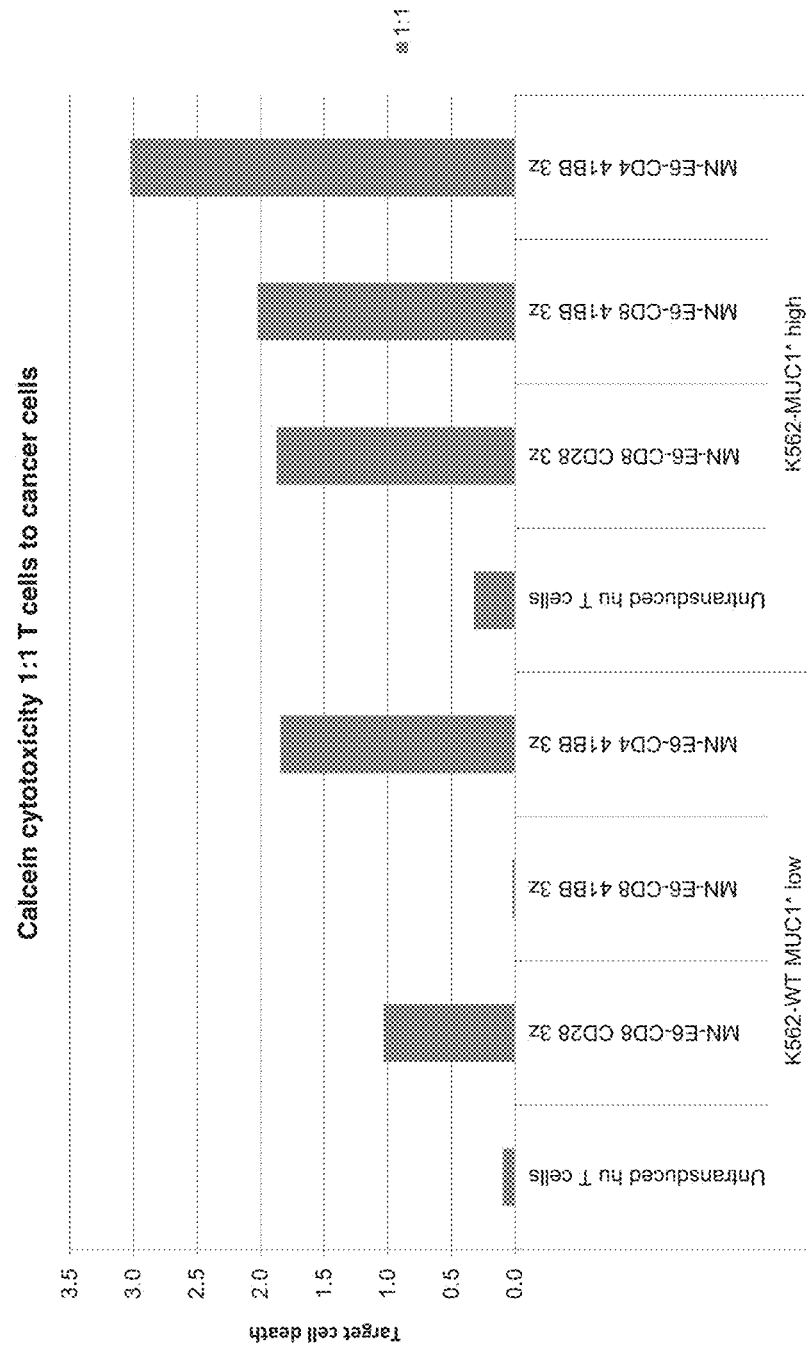
FIG. 34 is a graph of an experiment measuring target cell death when primary human T cells, isolated from a blood sample, that were transduced with a panel of CARs, including MN-E6-CD8-CD28-3z, MN-E6-CD8-41BB-3z and MN-E6-CD4-41BB-3z, when the CAR T cells were exposed to K562-wt cells or K562 cells that had been transfected with MUC1*. The ratio of T cells to target cells was 1:1 and the cells were co-cultured for 24 hours.
Figure 35:
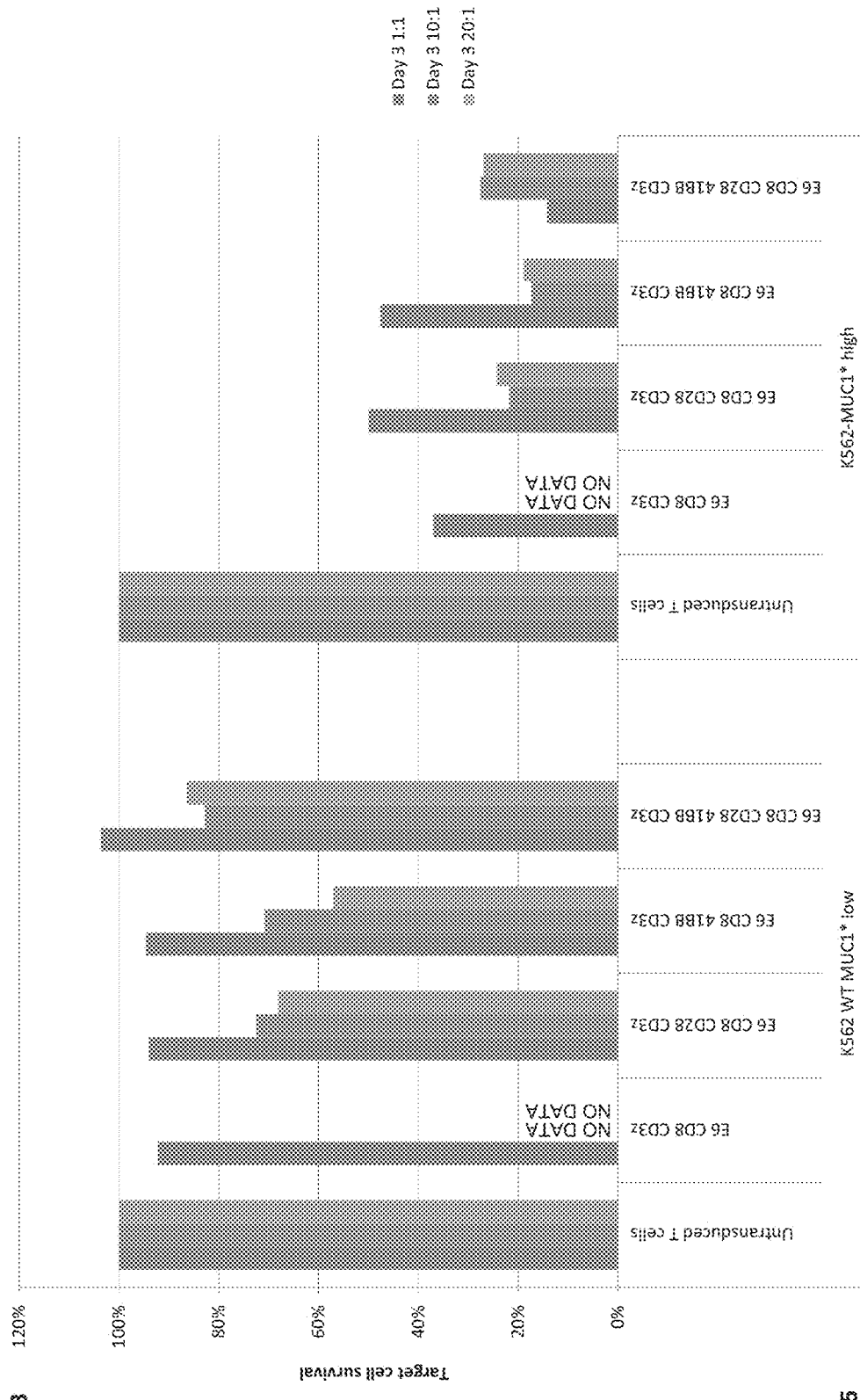
FIG. 35 is a graph of FACS measuring a time course of target cell survival from Day 1 to Day 3. Primary human T cells, isolated from a blood sample, were transduced with a panel of CARs, including humanized MN-E6-CD8-3z, MN-E6-CD8-CD28-3z, MN-E6-CD8-41BB-3z and MN-E6-CD8-CD28-41BB-3z. The CAR T cells were then exposed to K562-wt cells that naturally express low levels of MUC1*, or K562 cells that had been transfected with MUC1* high. The ratio of MUC1* targeting CART cells to target cells was either 1:1, 10:1, or 20:1. Surviving cells were detected and measured at Day 1 or Day 3 (B).

Another measure of function of CAR T cells is whether or not they induce killing of the targeted cells. T cells transfected with a variety of CARs comprising antibody fragments that bind to the PSMGFR sequence of MUC1* killed MUC1* expressing cells in co-culture assays. In one assay, target MUC1* expressing cells are incubated with calcein. When they are mixed with CAR T cells wherein the CAR comprises an antibody fragment such as MN-E6, MN-C2, MN-C3 or MN-C8 the CAR T cells kill the MUC1* presenting cells which causes the target cells to lyse and releases calcein into the supernatant. FIG. 34 is a graph of an experiment measuring target cell death when primary human T cells, isolated from a blood sample, that were transduced with a panel of CARs, including MN-E6 CD8/CD28/CD3z, MN-E6 CD8/41BB/CD3z and MN-E6 CD4/41BB/CD3z, when the CAR T cells were exposed to K562-wt cells or K562 cells that had been transfected with MUC1*. The ratio of T cells to target cells was 1:1 and the cells were co-cultured for 24 hours. FIG. 35 is a graph of FACS measuring a time course of target cell survival from Day 1 to Day 3. Primary human T cells, isolated from a blood sample, were transduced with a panel of CARs, including humanized MN-E6-CD8-3z, MN-E6-CD8-CD28-3z, MN-E6-CD8-41BB-3z and MN-E6-CD8-CD28-41BB-3z. The CAR T cells were then exposed to K562-wt cells that naturally express low levels of MUC1*, or K562 cells that had been transfected with MUC1* high. The ratio of MUC1* targeting CAR T cells to target cells was either 1:1, 10:1, or 20:1. Surviving cells were detected and measured at Day 1 (A) or Day 3 (B).

Figure 36:
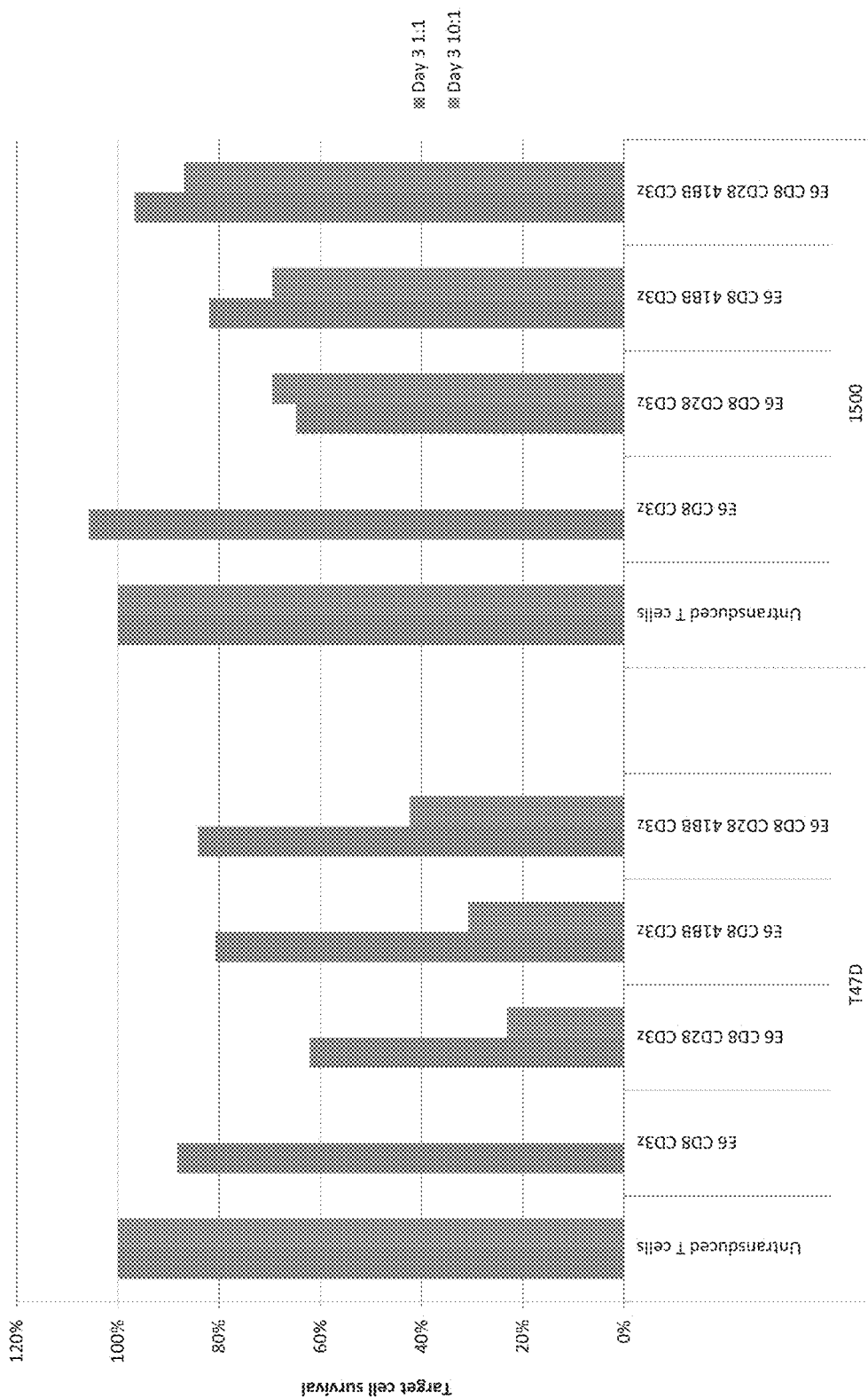
FIG. 36 is a graph of FACS measurements of target cell survival at Day 3 of co-culture experiment. Primary human T cells were transduced with a panel of CARs, including humanized MN-E6-CD8-3z, MN-E6-CD8-CD28-3z, MN-E6-CD8-41BB-3z and MN-E6-CD8-CD28-41BB-3z.

FIG. 36 is a graph of FACS measurements of target cell survival at Day 3 of co-culture experiment. Primary human T cells were transduced with a panel of CARs, including humanized MN-E6-CD8-3z, MN-E6-CD8-CD28-3z, MN-E6-CD8-41BB-3z and MN-E6-CD8-CD28-41BB-3z. The CAR T cells were then exposed to MUC1* positive T47D breast cancer cells or MUC1* positive 1500 aka ZR-75-1 breast cancer cells. The ratio of MUC1* targeting CAR T cells to target cells was either 1:1 or 10:1. As can be seen from the graph, T cells transduced with a MUC1* targeting CAR have a much greater killing effect on MUC1* cancer cells than the untransduced control T cells. In addition, the killing effect is much greater when the ratio of T cells: target cells is increased. FIG. 37 is a graph of FACS measurements of target cell survival at Day 1 of co-culture experiment. Primary human T cells were transduced with a panel of CARs, including humanized MN-E6-CD8-41BB-3z, MN-E6-CD4-41BB-3z, and MN-E6-CD8-CD28-41BB-3z. The CAR T cells were then exposed to the following MUC1* positive cancer cells: T47D breast cancer; capan2 pancreatic cancer; or DU-145 prostate cancer. The ratio of MUC1* targeting CAR T cells to target cells was 5:1. As can be seen from the graph, T cells transduced with a MUC1* targeting CAR have a much greater killing effect on MUC1* cancer cells than the untransduced control T cells. Note that the measurements were taken after 24 hours with only a 5:1 T cell to target cell ratio. Also note that MUC1* targeting CARs that have a CD4 extracellular domain-transmembrane-cytoplasmic tail work equally well as CD8 constructs. FIG. 38 is a graph of FACS measurements of target cell survival at Day 3 of co-culture experiment. Primary human T cells were transduced with a panel of CARs, including humanized MN-E6-CD8-41BB-3z, MN-E6-CD4-41BB-3z, and MN-E6-CD8-CD28-41BB-3z. The CAR T cells were then exposed to the following MUC1* positive cancer cells: K562 leukemia cells transfected with MUC1*; T47D breast cancer; 1500 aka ZR-75-1 breast cancer cells; or CAPAN-2 pancreatic cancer cells. In addition to the untransduced T cell controls, the assay was performed on PC3 MUC1* negative prostate cancer cells. The ratio of MUC1* targeting CAR T cells to target cells was 1:1. As can be seen from the graph, T cells transduced with a MUC1* targeting CAR have a much greater killing effect on MUC1* cancer cells than the untransduced control T cells. In addition, the killing effect is specific for MUC1* positive cells. Note that MUC1* targeting CARs that have a CD4 extracellular domain-transmembrane-cytoplasmic tail work equally well as CD8 constructs. FIG. 39 is a graph of FACS measurements of CART cell expansion over 24 hours in co-culture with target cells at a ratio of 5:1 CAR T cells to target cells. The primary human T cells were transduced with a panel of CARs, including humanized MN-E6-CD8-41BB-3z, MN-E6-CD4-41BB-3z, and MN-E6-CD8-CD28-41BB-3z. The CAR T cells were co-cultured with MUC1* positive T47D breast cancer cells, MUC1* positive Capan pancreatic cancer cells, and MUC1-negative cells HCT-116 colon cancer cells and HEK-293 human embryonic kidney cells. As can be seen from the graph, the CAR T population is increased in the presence of MUC1* positive cells. FIG. 40 shows a photograph of a Western blot of MUC1* targeting CARs. From 1 to 9 are: 1. MN-E6scFv-Fc-8-41BB-CD3z (Human Fc as hinge region with CD8 TM); 2: MN-E6scFv-FcH-8-41BB-CD3z (Human Fc hingeless as hinge region with CD8 TM); 3: MN-E6scFv-Fc-4-41BB-CD3z (Human Fc as hinge region with CD4 TM); 4: MN-E6scFv-FcH-4-41BB-CD3z (Human Fc as hingeless hinge region with CD4 TM); 5: MN-E6scFv-IgD-8-41BB-CD3z (hinge region from human IgD with CD8 TM); 6: MN-E6scFv-IgD-4-41BB-CD3z (hinge region from human IgD with CD4 TM); 7: MN-E6scFv-X4-8-41BB-CD3z (Long flexible linker as hinge region with CD8 TM); 8: MN-E6scFv-X4-4-41BB-CD3z (Long flexible linker as hinge region with CD4 TM); 9: MN-E6scFv-8-4-41BB-CD3z (Hinge region from CD8 and CD4 a with CD4 TM).

FIG. 41 shows graphs of FACS scans of T47D breast cancer cells co-cultured with human T cells that were transduced with MN-E6scFv-Fc-8-41BB-CD3z, MN-E6scFv-FcH-8-41BB-CD3z (hingeless), MN-E6scFv-Fc-4-41BB-CD3z, MN-E6scFv-IgD-8-41BB-CD3z, MN-E6scFv-X4-8-41BB-CD3z and MN-E6scFv-X4-4-41BB-CD3z. T cells and cancer cells were co-cultured at a 1:1 ratio for 48 hours. T cell counts were normalized to an average of all untransduced T cells and target cells were normalized to each specific cell type when co-cultured with untransduced T cells. The graph shows that when the CAR T cells are co-cultured with MUC1* positive cancer cells, the T cell population expands and the targeted cancer cell population decreases.

FIG. 42 shows graphs of FACS scans of T47D breast cancer cells, Capan-2 pancreatic cancer cells, K562-MUC1* transfected cells, and K562-wt cells that were co-cultured with human T cells that were transduced with MN- E6scFv-Fc-8-41BB-CD3z, MN-E6scFv-FcH-8-41BB-CD3z, MN-E6scFv-Fc-4-41BB-CD3z, MN-E6scFv-IgD-8-41BB-CD3z, MN-E6scFv-X4-8-41BB-CD3z and MN-E6scFv-X4-4-41BB-CD3z. T cells and cancer cells were co-cultured at a 1:1 ratio for 48 hours. T cell counts were normalized to an average of all untransduced T cells and target cells were normalized to each specific cell type when co-cultured with untransduced T cells. The graph shows that when the CAR T cells are co-cultured with MUC1* positive cancer cells, the T cell population expands and the targeted cancer cell population decreases.

As these experiments demonstrate, the critical portion of a CAR is the antibody fragment that directs the immune cell to the tumor cell. As we will show in the following section, MN-E6 and MN-C2 are specific for the form of MUC1* that is expressed on tumor cells. The next most important part of a CAR is the cytoplasmic tail bearing immune system co-stimulatory domains. The identity of these domains modulates the degree of immune response but in no way effect the specificity. As shown, the identity of the transmembrane portion of a CAR is the least important. It appears that as long as the transmembrane portion has some flexibility and is long enough to allow the antibody fragment to reach its cognate receptor on the tumor cell, it will suffice. This is demonstrated in FIGS. 40-42. CARs comprising the MN-E6 targeting antibody fragment, and intracellular co-stimulatory domains 41BB and CD3-zeta but having a variety of different extracellular, transmembrane and short cytoplasmic tail all worked in that they specifically killed the targeted cells while stimulating the expansion of the host T cells. These CARs with variable mid-sections are: MN-E6scFv-Fc-8-41BB-CD3z (Human Fc as hinge region with CD8 TM); 2: MN-E6scFv-FcH-8-41BB-CD3z (Human Fc hingeless as hinge region with CD8 TM); 3: MN-E6scFv-Fc-4-41BB-CD3z (Human Fc as hinge region with CD4 TM); 4: MN-E6scFv-FcH-4-41BB-CD3z (Human Fc as hingeless hinge region with CD4 TM); 5: MN-E6scFv-IgD-8-41BB-CD3z (hinge region from human IgD with CD8 TM); 6: MN-E6scFv-IgD-4-41BB-CD3z (hinge region from human IgD with CD4 TM); 7: MN-E6scFv-X4-8-41BB-CD3z (Long flexible linker as hinge region with CD8 TM); 8: MN-E6scFv-X4-4-41BB-CD3z (Long flexible linker as hinge region with CD4 TM); 9: MN-E6scFv-8-4-41BB-CD3z (Hinge region from CD8 and CD4 a with CD4 TM).

One aspect of the invention is a method for treating a patient diagnosed with, suspected of having, or at risk of developing a MUC1 positive or MUC1* positive cancer, wherein the patient is administered an effective amount of immune cells that have been transduced with a MUC1* targeting CAR, wherein the CAR is chosen from among the group consisting of MN-E6-CD8-3z; MN-E6-CD4-3z; MN-E6-CD8-CD28-3z; MN-E6-CD4-CD28-3z; MN-E6-CD8-41BB-3z; MN-E6-CD4-41BB-3z; MN-E6-CD8-CD28-41BB-3z; MN-E6-CD4-CD28-41BB-3z; MN-E6scFv-Fc-8-41BB-CD3z; MN-E6scFv-FcH-8-41BB-CD3z; MN-E6scFv-Fc-4-41BB-CD3z; MN-E6scFv-FcH-4-41BB-CD3z; MN-E6scFv-IgD-8-41BB-CD3z; MN-E6scFv-IgD-4-41BB-CD3z; MN-E6scFv-X4-8-41BB-CD3z; MN-E6scFv-X4-4-41BB-CD3z; MN-E6scFv-8-4-41BB-CD3z, or any of the aforementioned CARs wherein the MN-E6 is replaced by MN-C2, MN-C3 or MN-C8. Another aspect of the invention is a method for treating a patient diagnosed with, suspected of having, or at risk of developing a cancer, wherein the patient is administered an effective amount of immune cells that have been transduced with one of the aforementioned CARs wherein the MN-E6 is replaced by a peptide comprising antibody variable domain fragments that are specific for a cancer antigen. In any of the above methods, the immune cell may be a T cell and may further be isolated from the patient to be treated.

Specificity of Anti-MUC1* Targeting Antibodies

Figure 43:
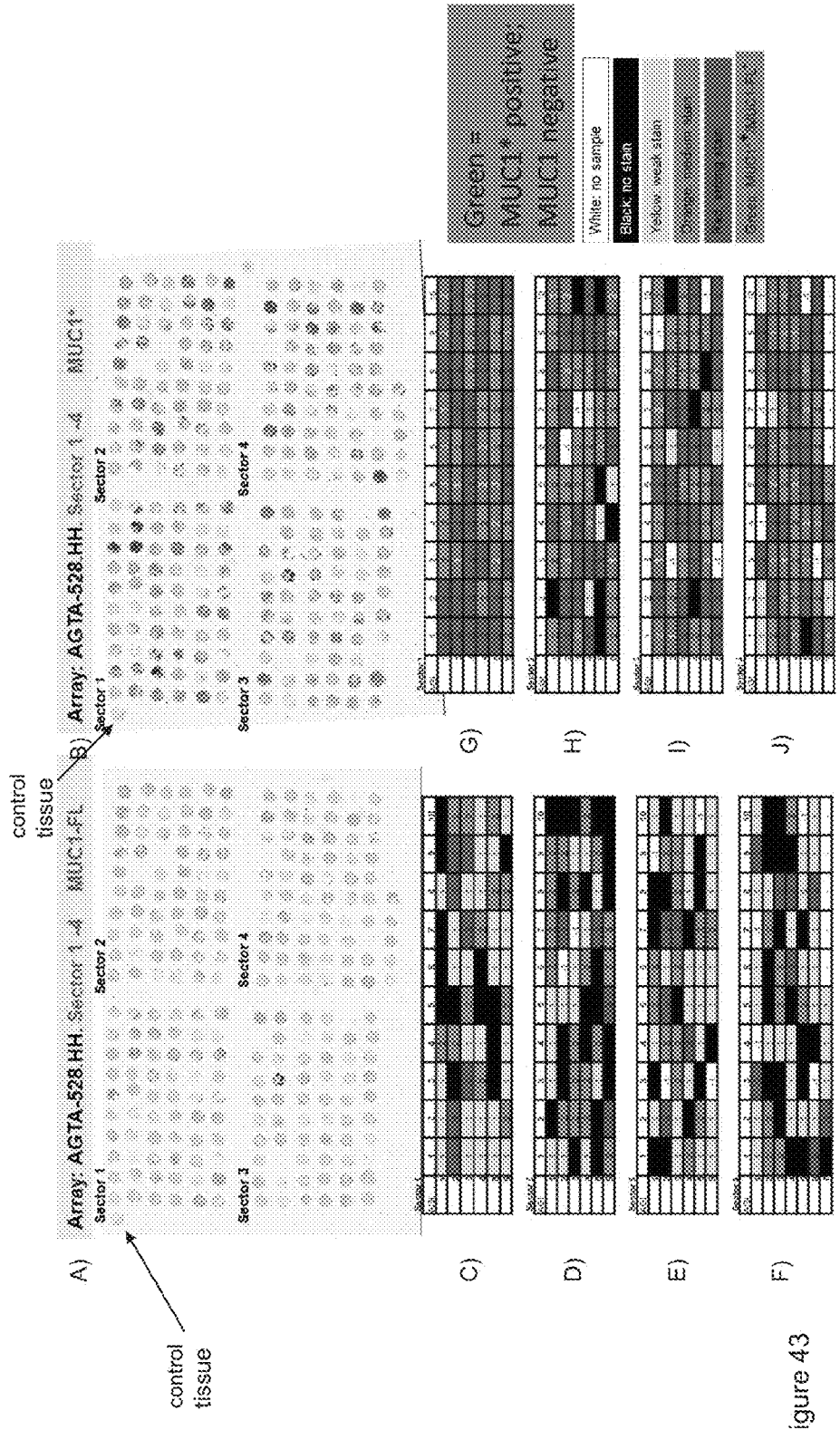
Figure 44:
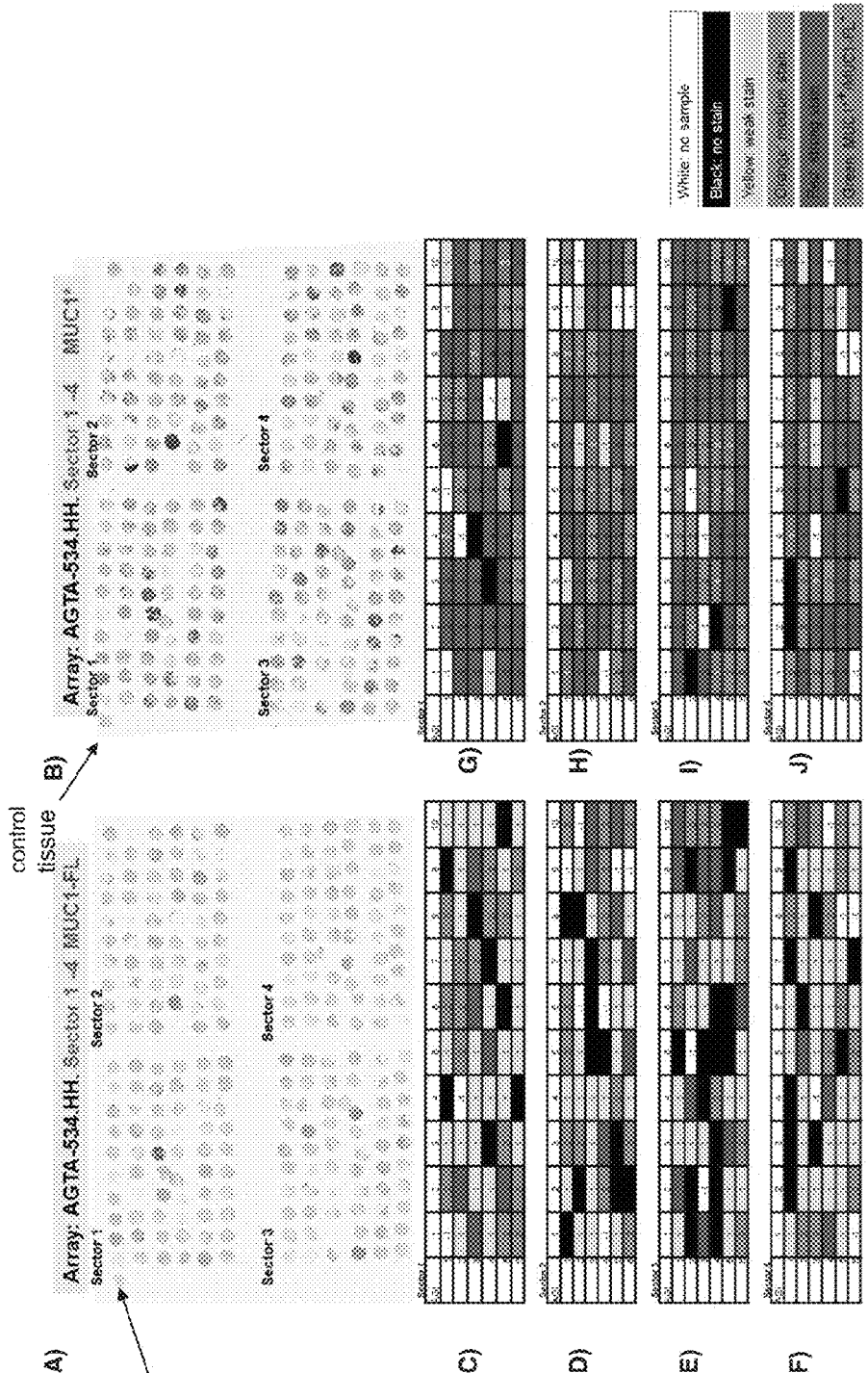

The most accurate way of demonstrating antibody specificity is testing the antibody on normal human tissue specimens compared to cancerous tissue specimens. MN-C2 and MN-E6 were shown to specifically bind to MUC1 or MUC1* positive cancer cells. Several breast tumor arrays were assayed using several anti-MUC1 or MUC1* antibodies. Essentially the studies involving serial sections of breast cancer tissue specimens from over 1,200 different breast cancer patients showed that very little full-length MUC1 remains on breast cancer tissues. The vast majority of the MUC1 expressed is MUC1* and is stained by MN-C2. The analysis was performed by Clarient Diagnostics and tissue staining was scored using the Allred method. For example, FIG. 43 shows serial sections of breast cancer tissue arrays that were stained with either VU4H5, a commercially available anti-MUC1 antibody that binds to the tandem repeats, or MN-C2 that binds to MUC1*. FIGS. 43 and 44 are photographs of breast cancer tissue arrays stained with either VU4H5 which recognizes MUC1-FL (full length) or MN-C2 which recognizes cancerous MUC1*. Tissue staining was scored using Allred scoring method which combines an intensity score and a distribution score. Below the photographs of the tissue arrays are color-coded graphs displaying the results. As can be seen, the arrays stained with VU4H5 are very light and many tissues do not stain at all despite the published reports that MUC1 is aberrantly expressed on over 96% of all breast cancers as evidenced by nucleic acid based diagnostics. In contrast, the arrays stained with MN-C2 are very dark (red versus yellow or white in graph). Additionally, many tissues did not stain at all with anti-full-length MUC1 but stained very dark with MN-C2, (see green boxes in graph). Similarly, we stained normal or cancerous breast tissues with humanized MN-E6 scFv-Fc. The antibody fragment was biotinylated so it could be visualized by a secondary streptavidin based secondary. As can be seen in FIG. 45, hMN-E6 scFv-Fc does not stain normal breast tissue but stains cancerous breast tissue. Further, the intensity and homogeneity of staining increases with tumor grade and/or metastatic grade of the patient (FIGS. 45 and 46). Similarly, hMN-E6 scFv-Fc did not stain normal lung tissue but did stain lung cancer tissue (FIGS. 47-51) and the intensity and distribution of staining increased as tumor grade or metastatic grade increased. FIG. 52 shows photographs of normal small intestine and cancerous small intestine tissues stained with humanized MN-E6-scFv-Fc biotinylated anti-MUC1* antibody at 5 ug/mL, then stained with a secondary streptavidin HRP antibody. A) is a normal small intestine tissue. B) is small intestine cancer from patient as denoted in the figure. C,D are photographs of the corresponding serial sections that were stained with the secondary antibody alone. FIG. 53 shows photographs of normal small intestine tissues stained with humanized MN-E6-scFv-Fc anti-MUC1* antibody at 50 ug/mL, then stained with a secondary goat-anti-human HRP antibody. A-D are normal small intestine tissue. E-H are photographs of the corresponding serial sections that were stained with the secondary antibody alone. FIG. 54 shows photographs of cancerous small intestine tissues stained with humanized MN-E6-scFv-Fc anti-MUC1* antibody at 50 ug/mL, then stained with a secondary goat-anti-human HRP antibody. A-D are cancerous small intestine tissue from a patient as denoted in figure. E-H are photographs of the corresponding serial sections that were stained with the secondary antibody alone. FIG. 55 shows photographs of cancerous small intestine tissues stained with humanized MN-E6-scFv-Fc anti-MUC1* antibody at 50 ug/mL, then stained with a secondary goat-anti-human HRP antibody. A-D are cancerous small intestine tissue from a patient as denoted in figure. E-H are photographs of the corresponding serial sections that were stained with the secondary antibody alone. FIG. 56 shows photographs of normal colon tissues stained with humanized MN-E6-scFv-Fc anti-MUC1* antibody at 50 ug/mL, then stained with a secondary goat-anti-human HRP antibody. A-D are normal colon. E-H are photographs of the corresponding serial sections that were stained with the secondary antibody alone. FIG. 57 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a metastatic patient as denoted in figure. E-H are photographs of the corresponding serial sections that were stained with the secondary antibody alone. FIG. 58 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a Grade 2 patient as denoted in figure. E-H are photographs of the corresponding serial sections that were stained with the secondary antibody alone. FIG. 59 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a metastatic patient as denoted in figure. E-H are photographs of the corresponding serial sections that were stained with the secondary antibody alone. FIG. 60 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone. FIG. 61 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone. FIG. 62 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone.

One aspect of the invention is a method for treating a patient diagnosed with, suspected of having, or at risk of developing a MUC1 positive or MUC1* positive cancer, wherein a specimen is obtained from the patient's cancer and is tested for reactivity with an antibody that binds to PSMGFR SEQ ID NO:2, SNIKFRPGSVVVQLTLAFREGTINVHDVETQFNQYKTEAASRY (SEQ ID NO:620) or SVVVQLTLAFREGTINVHDVETQFNQYKTEAASRY (SEQ ID NO:621).

The patient is then treated with an scFv, scFv-Fc or CAR T that comprises antibody variable fragments from the antibody that reacted with their cancer specimen. Another aspect of the invention is a method for treating a patient diagnosed with, suspected of having, or at risk of developing a MUC1 positive or MUC1* positive cancer, wherein a specimen is obtained from the patient's cancer and is tested for reactivity with MN-E6-scFv, MN-C2-scFv, MN-C3-scFv or MN-C8-scFv; the patient is then treated with the scFv, scFv-Fc-mut or CAR T that comprises portions of the antibody that reacted with their cancer specimen.

BiTEs

Divalent (or bivalent) single-chain variable fragments (di-says, bi-scFvs) can be engineered by linking two says. This can be done by producing a single peptide chain with two $V_H$ and two $V_L$ regions, yielding tandem scFvs. Another possibility is the creation of scFvs with linker peptides that are too short for the two variable regions to fold together (about five amino acids), forcing scFvs to dimerize. This type is known as diabodies. Diabodies have been shown to have dissociation constants up to 40-fold lower than corresponding scFvs, meaning that they have a much higher affinity to their target. Consequently, diabody drugs could be dosed much lower than other therapeutic antibodies and are capable of highly specific targeting of tumors in vivo. Still shorter linkers (one or two amino acids) lead to the formation of trimmers, so-called triabodies or tribodies. Tetrabodies have also been produced. They exhibit an even higher affinity to their targets than diabodies.

All of these formats can be composed from variable fragments with specificity for two different antigens, in which case they are types of bispecific antibodies. The furthest developed of these are bispecific tandem di-scFvs, known as hi-specific I-cell engagers (BiTE antibody constructs). BiTEs are fusion proteins consisting of two scFvs of different antibodies, on a. single peptide chain of about 55 kilodaltons. One of the scFvs may bind to T cells such as via. the CD3 receptor, and the other to a tumor cell via a tumor specific molecule, such aberrantly expressed MUC1*.

Another aspect of the invention is a method for treating a patient diagnosed with, suspected of having, or at risk of developing a MUC1 positive or MUC1* positive cancer, wherein the patient is administered an effective amount of a BiTE wherein one antibody variable fragment of the BiTE binds to a T cell surface antigen and the other antibody variable fragment of the BiTE binds to PSMGFR SEQ ID NO:2, SNIKFRPGSVVVQLTLAFREGTINVHD-VETQFNQYKTEAASRY (SEQ ID NO:620) or SVVVQLTLAFREGTINVHDVETQFNQYKTEAASRY (SEQ ID NO:621). In one case, the antibody variable fragment of the BiTE that binds to MUC1* comprises portions of huMN-E6, huMN-C2, huMN-C3, or huMN-C8.

In another aspect of the invention, MUC1* peptides including PSMGFR SEQ ID NO:2, most or all of SNIKFRPGSVVVQLTLAFREGTINVHDVETQFNQYK-TEAASRY (SEQ ID NO:620) or SVVVQLTLAFREGT-INVHDVETQFNQYKTEAASRY (SEQ ID NO:621) are used in adoptive T cell approaches. In this case, a patient's T cells are exposed to the MUC1* peptides and through various rounds of maturation, the T cells develop MUC1* specific receptors. The adapted T cells are then expanded and administered to the donor patient who is diagnosed with, suspected of having, or is at risk of developing a MUC1* positive cancer.

Other MUC1 Cleavage Sites

However, MUC1 is cleaved to the growth factor receptor form, MUC1*, on some healthy cells in addition to cancer cells. For example, MUC1 is cleaved to MUC1* on healthy stem and progenitor cells. A large percentage of bone marrow cells are MUC1* positive. Portions of the intestine are MUC1* positive.

The inventors have discovered that MUC1 can be cleaved at different positions that are relatively close to each other but the location of cleavage changes the fold of the remaining portion of the extracellular domain. As a result, monoclonal antibodies can be identified that bind to MUC1* cleaved at a first position but do not bind to MUC1* that has been cleaved at a second position. This discovery is disclosed in WO2014/028668, filed Aug. 14, 2013, the contents of which are incorporated by reference herein its entirety. We identified a set of anti-MUC1* monoclonal antibodies that bind to a MUC1* as it appears on cancer cells but do not bind to MUC1* as it appears on stem and progenitor cells. Conversely, we identified a second set of monoclonal antibodies that bind to stem and progenitor cells but do not bind to cancer cells. One method used to identify stem specific antibodies is as follows: supernatants from monoclonal hybridomas were separately adsorbed onto 2 multi-well plates. Stem cells, which are non-adherent cells, were put into one plate and cancer cells which are adherent were put into an identical plate. After an incubation period, the plates were rinsed and inverted. If the non-adherent stem cells stuck to the plate, then the monoclonal in that particular well recognizes stem cells and will not recognize cancer cells. Antibodies that did not capture stem cells or antibodies that captured cancer cells were identified as cancer specific stem cells. FACS analysis has confirmed this method works. Antibodies MN-E6 and MN-C2 are examples of cancer-specific antibodies. Antibodies MN-C3 and MN-C8 are examples of stem-specific antibodies. Although both sets of antibodies are able to bind to a peptide having the PSMGFR sequence, FACS analysis shows that the anti-MUC1* polyclonal antibody and MN-C3 bind to MUC1* positive bone marrow cells but MN-E6 does not. The MUC1* polyclonal antibody was generated by immunizing a rabbit with the PSMGFR peptide. Similarly, MN-C3 binds to stem cells of the intestinal crypts but MN-E6 does not. Conversely, MN-E6 antibody binds to cancerous tissue while the stem-specific MN-C3 does not. Competition ELISA experiments indicate that the C-terminal 10 amino acids of the PSMGFR peptide are required for MN-E6 and MN-C2 binding, but not for MN-C3 and MN-C8. Therefore, another method for identifying antibodies that are cancer specific is to immunize with a peptide having the sequence of the PSMGFR peptide minus the 10 N-terminal amino acids or use that peptide to screen for antibodies or antibody fragments that will be cancer specific. Antibodies that bind to a peptide with a sequence of PSMGFR peptide minus the N-terminal 10 amino acids but do not bind to a peptide with a sequence of PSMGFR peptide minus the C-terminal 10 amino acids are cancer specific antibodies for use in the treatment or prevention of cancers.

The extracellular domain of MUC1 is also cleaved on stem cells and some progenitor cells, where activation of cleaved MUC1 by ligands NME1 in dimer form or NME7 promotes growth and pluripotency and inhibits differentiation. The transmembrane portion of MUC1 that remains after cleavage is called MUC1* and the extracellular domain is comprised essentially of the Primary Sequence of MUC1 Growth Factor Receptor (PSMGFR) sequence. However, the exact site of cleavage can vary depending on cell type, tissue type, or which cleavage enzyme a particular person expresses or overexpresses. In addition to the cleavage site that we previously identified which leaves the transmembrane portion of MUC1* comprising most or all of the PSMGFR SEQ ID NO:2, other cleavage sites result in an extended MUC1* comprised of most or all of SNIKFRPGSVVVQLTLAFREGTINVHDVETQFNQYK-TEAASRY (SEQ ID NO:620); or SVVVQLTLAFREGT-INVHDVETQFNQYKTEAASRY (SEQ ID NO:621). The site of MUC1 cleavage affects how the remaining extracellular domain folds. We have identified monoclonal antibodies that bind to cleaved MUC1* on cancer cells but do not bind to cleaved MUC1* as it exists on healthy stem and progenitor cells.

Whereas an anti-MUC1* antibody or antibody-like molecule may be most effective if it competitively inhibits the binding of NME1, NME6, NME8 or NME7 or NME7-AB to MUC1*, for example an antibody that binds to the PSMGFR sequence especially if said antibody is unable to bind to a PSMGFR peptide if the 10 C-terminal amino acids are missing, antibodies or antibody-like molecules that carry a payload need not competitively inhibit the binding of MUC1* ligands to be effective as anti-cancer agents. For example antibodies or antibody-like molecules that are conjugated to a toxin could be effective at killing target cancer cells without necessarily inhibiting binding of the activating ligands. For example, antibodies or antibody-like molecules such as CARs or BiTEs which recruit the patient's immune system to the tumor can be effective as anti-cancer agents even if the antibody fragment targets a portion of MUC1* such that antibody fragment binding does not competitively inhibit the binding of NME1, NME6, NME8, NME7-AB or NME7. In a preferred embodiment the antibody fragment incorporated into a CAR, an adaptive T cell receptor or a BiTE does competitively inhibit the binding of NME1, NME6, NME8, NME7-AB or NME7 to MUC1*.

Antibodies that are able to bind to the extracellular domain of the remaining transmembrane portion block the interaction between the MUC1* extracellular domain and activating ligands and in this way can be used as therapeutic agents, for example for the treatment of cancers. Anti-MUC1* antibodies are also useful for the growth, delivery, identification or isolation of stem cells both in vitro and in vivo.

General Strategy for Using Antibodies, Antibody Fragments and CARs that Target the Extracellular Domain of MUC1*

Monoclonal antibodies MN-C3 and MN-C8 have a greater binding affinity for stem cells than cancer cells. Humanized antibodies and antibody fragments containing sequences derived from the variable regions of MN-C3 and MN-C8 can be used as an adhesion surface coating for human stem cells.

Alternatively, humanized antibodies and antibody fragments containing sequences derived from the variable regions of MN-C3 and MN-C8 can be used to deliver stem cells to a specific location such as for in situ human therapeutics. In one case, a substrate coated with humanized MN-C3 or MN-C8 derived antibodies or antibody fragments is loaded with stem cells then inserted into a patient. In another case, a substrate coated with humanized MN-C3 or MN-C8 derived antibodies or antibody fragments is inserted into a patient in order to recruit the patient's own stem cells to a specific area for therapy. Human therapies in which antibodies that bind to human stem cells will be of therapeutic use include spinal cord repair. Substrates coated with humanized MN-C3 or MN-C8 derived antibodies or antibody fragments are also used to identify or isolate human antibodies. Humanized MN-C3 or MN-C8 derived antibodies can also be used to stimulate the growth of stem cells.

Sequence Listing Free Text

ASCII text file named "6977 3710 Sequence Listing.txt" having byte size of 602659, created Aug. 9, 2020 is incorporated by reference herein.

As regards the use of nucleotide symbols other than a, g, c, t, they follow the convention set forth in WIPO Standard ST.25, Appendix 2, Table 1, wherein k represents t or g; n represents a, c, t or g; m represents a or c; r represents a or g; s represents c or g; w represents a or t and y represents c or t.

```
MUC1 Receptor
(Mucin 1 precursor, Genbank Accession number: P15941)
                                                                  (SEQ ID NO: 1)
MTPGTQSPFFLLLLLTVLTVVTGSGHASSTPGGEKETSATQRSSVPSSTEKNAVSMTSSVLSSHSPGSGSSTT

QGQDVTLAPATEPASGSAATWGQDVTSVPVTRPALGSTTPPAHDVTSAPDNKPAPGSTAPPAHGVTSAPDTRP

APGSTAPPAHGVTSAPDTRPAPGSTAPPAHGVTSAPDTRPAPGSTAPPAHGVTSAPDTRPAPGSTAPPAHGVT

SAPDTRPAPGSTAPPAHGVTSAPDTRPAPGSTAPPAHGVTSAPDTRPAPGSTAPPAHGVTSAPDTRPAPGSTA

PPAHGVTSAPDTRPAPGSTAPPAHGVTSAPDTRPAPGSTAPPAHGVTSAPDTRPAPGSTAPPAHGVTSAPDTR

PAPGSTAPPAHGVTSAPDTRPAPGSTAPPAHGVTSAPDTRPAPGSTAPPAHGVTSAPDTRPAPGSTAPPAHGV

TSAPDTRPAPGSTAPPAHGVTSAPDTRPAPGSTAPPAHGVTSAPDTRPAPGSTAPPAHGVTSAPDTRPAPGST

APPAHGVTSAPDTRPAPGSTAPPAHGVTSAPDTRPAPGSTAPPAHGVTSAPDTRPAPGSTAPPAHGVTSAPDT

RPAPGSTAPPAHGVTSAPDTRPAPGSTAPPAHGVTSAPDTRPAPGSTAPPAHGVTSAPDTRPAPGSTAPPAHG

VTSAPDTRPAPGSTAPPAHGVTSAPDTRPAPGSTAPPAHGVTSAPDTRPAPGSTAPPAHGVTSAPDTRPAPGS

TAPPAHGVTSAPDTRPAPGSTAPPAHGVTSAPDTRPAPGSTAPPAHGVTSAPDTRPAPGSTAPPAHGVTSAPD

TRPAPGSTAPPAHGVTSAPDTRPAPGSTAPPAHGVTSAPDTRPAPGSTAPPAHGVTSAPDTRPAPGSTAPPAH

GVTSAPDTRPAPGSTAPPAHGVTSAPDTRPAPGSTAPPAHGVTSAPDTRPAPGSTAPPAHGVTSAPDNRPALG

STAPPVHNVTSASGSASGSASTLVHNGTSARATTTPASKSTPFSIPSHHSDTPTTLASHSTKTDASSTHHSSV

PPLTSSNHSTSPQLSTGVSFFFLSFHISNLQFNSSLEDPSTDYYQELQRDISEMFLQIYKQGGFLGLSNIKFR

PGSVVVQLTLAFREGTINVHDVETQFNQYKTEAASRYNLTISDVSVSDVPFPFSAQSGAGVPGWGIALLVLVC

VLVALAIVYLIALAVCQCRRKNYGQLDIFPARDTYHPMSEYPTYHTHGRYVPPSSTDRSPYEKVSAGNGGSSL
```

```
SYTNPAVAAASANL
PSMGFR
```

```
                                                           (SEQ ID NO: 2)
GTINVHDVETQFNQYKTEAASRYNLTISDVSVSDVPFPFSAQSGA
```

Human NME1
(DNA)

```
                                                           (SEQ ID NO: 3)
atggccaactgtgagcgtaccttcattgcgatcaaaccagatgggggtccagcggggtcttgtgggagagatta tcaagcgttttgagcagaaaggattccgccttgttggtctgaaattcatgcaagcttccgaagatcttctcaa ggaacactacgttgacctgaaggaccgtccattctttgccggcctggtgaaatacatgcactcagggccggta gttgccatggtctgggaggggctgaatgtggtgaagacgggccgagtcatgctcggggagaccaaccctgcag actccaagcctgggaccatccgtggagacttctgcatacaagttggcaggaacattatacatggcagtgattc tgtggagagtgcagagaaggagatcggcttgtggtttcaccctgaggaactggtagattacacgagctgtgct cagaactggatctatgaatga
```

(amino acids)

```
                                                           (SEQ ID NO: 4)
MANCERTFIAIKPDGVQRGLVGEIIKRFEQKGFRLVGLKFMQASEDLLKEHYVDLKDRPFFAGLVKYMHSGPV
VAMVWEGLNVVKTGRVMLGETNPADSKPGTIRGDFCIQVGRNIIHGSDSVESAEKEIGLWFHPEELVDYTSCA
QNWIYE-
```

Human NME7
(DNA)

```
                                                           (SEQ ID NO: 5)
atgaatcatagtgaaagattcgttttcattgcagagtggtatgatccaaatgcttcacttcttcgacgttatg agctttatttttacccaggggatggatctgttgaaatgcatgatgtaaagaatcatcgcaccttttaaagcg gaccaaatatgataacctgcacttggaagatttattataggcaacaaagtgaatgtctttttctcgacaactg gtattaattgactatggggatcaatatacagctcgccagctgggcagtaggaaagaaaaaacgctagccctaa ttaaaccagatgcaatatcaaaggctggagaaataattgaaataataaacaaagctggatttactataaccaa actcaaaatgatgatgcttttcaaggaaagaagcattggattttcatgtagatcaccagtcaagacccttttttc aatgagctgatccagtttattacaactggtcctattattgccatggagattttaagagatgatgctatatgtg aatggaaaagactgctgggacctgcaaactctggagtggcacgcacagatgcttctgaaagcattagagccct ctttggaacagatggcataagaaatgcagcgcatggccctgattcttttgcttctgcggccagagaaatggag ttgtttttccttcaagtggaggttgtgggccggcaaacactgctaaatttactaattgtacctgttgcattg ttaaacccccatgctgtcagtgaaggactgttgggaaagatcctgatggctatccgagatgcaggttttgaaat ctcagctatgcagatgttcaatatggatcgggttaatgttgaggaattctatgaagtttataaaggagtagtg accgaatatcatgacatggtgacagaaatgtattctggcccttgtgtagcaatggagattcaacagaataatg ctacaaagacatttcgagaattttgtggacctgctgatcctgaaattgcccggcatttacgccctgaactct cagagcaatctttggtaaaactaagatccagaatgctgttcactgtactgatctgccagaggatggcctatta gaggttcaatacttcttcaagatcttggataattag
```

(amino acids)

```
                                                           (SEQ ID NO: 6)
MNHSERFVFIAEWYDPNASLLRRYELLFYPGDGSVEMHDVKNHRTFLKRTKYDNLHLEDLFIGNKVNVFSRQL
VLIDYGDQYTARQLGSRKEKTLALIKPDAISKAGEIIEIINKAGFTITKLKMMMLSRKEALDFHVDHQSRPFF
NELIQFITTGPIIAMEILRDDAICEWKRLLGPANSGVARTDASESIRALFGTDGIRNAAHGPDSFASAAREME
LFFPSSGGCGPANTAKFTNCTCCIVKPHAVSEGLLGKILMAIRDAGFEISAMQMFNMDRVNVEEFYEVYKGVV
TEYHDMVTEMYSGPCVAMEIQQNNATKTFREFCGPADPEIARHLRPGTLRAIFGKTKIQNAVHCTDLPEDGLL
EVQYFFKILDN-
```

```
NME7 peptides
NME7A peptide 1 (A domain):
                                                              (SEQ ID NO: 7)
MLSRKEALDFHVDHQS NME7A peptide 2 (A domain):
                                                              (SEQ ID NO: 8)
SGVARTDASES NME7B peptide 1 (B domain):
                                                              (SEQ ID NO: 9)
DAGFEISAMQMFNMDRVNVE NME7B peptide 2 (B domain):
                                                             (SEQ ID NO: 10)
EVYKGVVTEYHDMVTE NME7B peptide 3 (B domain):
                                                             (SEQ ID NO: 11)
AIFGKTKIQNAVHCTDLPEDGLLEVQYFF Mouse E6 Heavy chain variable region sequence:
(DNA)
                                                             (SEQ ID NO: 12)
gaggtgaaggtggtggagtctggggggagacttagtgaagcctggagggtccctgaaactctcctgtgtagtct ctggattcactttcagtagatatggcatgtcttgggttcgccagactccaggcaagaggctggagtgggtcgc aaccattagtggtggcggtacttacatctactatccagacagtgtgaaggggcgattcaccatctccagagac aatgccaagaacaccctgtacctgcaaatgagcagtctgaagtctgaggacacagccatgtatcactgtacaa gggataactacggtaggaactacgactacggtatggactactggggtcaaggaacctcagtcaccgtctcctc a (amino acids)
                                                             (SEQ ID NO: 13)
EVKVVESGGDLVKPGGSLKLSCVVSGFTFSRYGMSWVRQTPGKRLEWVATISGGGTYIYYPDSVKGRFTISRD
NAKNTLYLQMSSLKSEDTAMYHCTRDNYGRNYDYGMDYWGQGTSVTVSS Mouse E6 heavy chain variable framework region 1 (FWR1) sequence:
(DNA)
                                                             (SEQ ID NO: 14)
gaggtgaaggtggtggagtctggggggagacttagtgaagcctggagggtccctgaaactctcctgtgtagtct
ct (amino acids)
                                                             (SEQ ID NO: 15)
EVKVVESGGDLVKPGGSLKLSCVVSGFTFS Mouse E6 heavy chain variable complementarity determining regions 1
(CDR1) sequence:
(DNA)
                                                             (SEQ ID NO: 16)
ggattcactttcagtagatatggcatgtct (amino acids)
                                                             (SEQ ID NO: 17)
RYGMS Mouse E6 heavy chain variable framework region 2 (FWR2) sequence:
(DNA)
                                                             (SEQ ID NO: 18)
tgggttcgccagactccaggcaagaggctggagtgggtcgca (amino acids)
                                                             (SEQ ID NO: 19)
WVRQTPGKRLEWVA Mouse E6 heavy chain variable complementarity determining regions 2
(CDR2) sequence:
(DNA)
                                                             (SEQ ID NO: 20)
accattagtggtggcggtacttacatctactatccagacagtgtgaagggg (amino acids)
                                                             (SEQ ID NO: 21)
TISGGGTYIYYPDSVKG
```

Mouse E6 heavy chain variable framework region 3 (FWR3) acid sequence:
(DNA)
(SEQ ID NO: 22)
cgattcaccatctccagagacaatgccaagaacaccctgtacctgcaaatgagcagtctgaagtctgaggaca
cagccatgtatcactgtacaagg (amino acids)
(SEQ ID NO: 23)
RFTISRDNAKNTLYLQMSSLKSEDTAMYHCTR Mouse E6 heavy chain variable complementarity determining regions 3
(CDR3) sequence:
(DNA)
(SEQ ID NO: 24)
gataactacggtaggaactacgactacggtatggactac (amino acids)
(SEQ ID NO: 25)
DNYGRNYDYGMDY IGHV3-21*03 heavy chain variable region sequence:
(DNA)
(SEQ ID NO: 26)
gaggtgcagctggtggagtctgggggaggcctggtcaagcctggggggtccctgagactctcctgtgcagcct ctggattcaccttcagtagctatagcatgaactgggtccgccaggctccagggaaggggctggagtgggtctc atccattagtagtagtagtagttacatatactacgcagactcagtgaagggccgattcaccatctccagagac aacgccaagaactcactgtatctgcaaatgaacagcctgagagccgaggacacggctgtgtattactgtgcga ga (amino acids)
(SEQ ID NO: 27)
EVQLVESGGGLVKPGGSLRLSCAASGFTFSSYSMNWVRQAPGKGLEWVSSISSSSSYIYYADSVKGRFTISRD
NAKNSLYLQMNSLRAEDTAVYYCAR IGHV3-21*01 heavy chain variable framework region 1 (FWR1) sequence:
(DNA)
(SEQ ID NO: 28)
gaggtgcagctggtggagtctgggggaggcctggtcaagcctggggggtccctgagactctcctgtgcagcct
ctggattcaccttcagt (amino acids)
(SEQ ID NO: 29)
EVQLVESGGGLVKPGGSLRLSCAASGFTFS IGHV3-21*01 heavy chain variable complementarity determining regions 1
(CDR1) sequence:
(DNA)
(SEQ ID NO: 30)
agctatagcatgaac (amino acids)
(SEQ ID NO: 31)
SYSMN IGHV3-21*01 heavy chain variable framework region 2 (FWR2) sequence:
(DNA)
(SEQ ID NO: 32)
tgggtccgccaggctccagggaaggggctggagtgggtctca (amino acids)
(SEQ ID NO: 33)
WVRQAPGKGLEWVS IGHV3-21*01 heavy chain variable complementarity determining regions 2
(CDR2) sequence:
(DNA)
(SEQ ID NO: 34)
tccattagtagtagtagtagttacatatactacgcagactcagtgaagggc (amino acids)
(SEQ ID NO: 35)
SISSSSSYIYYADSVKG IGHV3-21*01 heavy chain variable framework region 3 (FWR3) sequence:
(DNA)
(SEQ ID NO: 36)
cgattcaccatctccagagacaacgccaagaactcactgtatctgcaaatgaacagcctgagagccgaggaca
cggctgtgtattactgtgcgaga (amino acids)
(SEQ ID NO: 37)
RFTISRDNAKNSLYLQMNSLRAEDTAVYYCAR Humanized E6 heavy chain variable region sequence:
(DNA)
(SEQ ID NO: 38)
gaggtgcagctggtggagtctgggggaggcctggtcaagcctggggggtccctgagactctcctgtgcagcct ctggattcaccttcagtaggtatggcatgagctgggtccgccaggctccagggaagaggctggagtgggtctc aaccattagtggcggaggcacctacatatactacccagactcagtgaagggccgattcaccatctccagagac aacgccaagaacaccctgtatctgcaaatgaacagcctgagagccgaggacacggctgtgtattactgtacca gagataactatggccgcaactatgattatggcatggattattggggccagggcaccctggtgaccgtgagcag c (amino acids)
(SEQ ID NO: 39)
EVQLVESGGGLVKPGGSLRLSCAASGFTFSRYGMSWVRQAPGKRLEWVSTISGGGTYIYYPDSVKGRFTISRD
NAKNTLYLQMNSLRAEDTAVYYCTRDNYGRNYDYGMDYWGQGTLVTVSS Humanized E6 heavy chain variable framework region 1 (FWR1) acid
sequence:
(DNA)
(SEQ ID NO: 40)
gaggtgcagctggtggagtctgggggaggcctggtcaagcctggggggtccctgagactctcctgtgcagcct
ctggattcaccttcagt (amino acids)
(SEQ ID NO: 41)
VQLVESGGGLVKPGGSLRLSCAASGFTFS Humanized E6 heavy chain variable complementarity determining regions 1
(CDR1) sequence:
(DNA)
(SEQ ID NO: 42)
aggtatggcatgagc (amino acids)
(SEQ ID NO: 43)
RYGMS Humanized E6 heavy chain variable framework region 2 (FWR2) acid
sequence:
(DNA)
(SEQ ID NO: 44)
tgggtccgccaggctccagggaagaggctggagtgggtctca (amino acids)
(SEQ ID NO: 45)
WVRQAPGKRLEWVS Humanized E6 heavy chain variable complementarity determining regions 2
(CDR2) sequence:
(DNA)
(SEQ ID NO: 46)
accattagtggcggaggcacctacatatactacccagactcagtgaagggc (amino acids)
(SEQ ID NO: 47)
TISGGGTYIYYPDSVKG Humanized E6 heavy chain variable framework region 3 (FWR3) acid
sequence:
(DNA)
(SEQ ID NO: 48)
cgattcaccatctccagagacaacgccaagaacaccctgtatctgcaaatgaacagcctgagagccgaggaca
cggctgtgtattactgtaccaga (amino acids)
(SEQ ID NO: 49)
RFTISRDNAKNTLYLQMNSLRAEDTAVYYCTR Humanized E6 heavy chain variable complementarity determining regions 3
(CDR3) sequence:
(DNA)

(SEQ ID NO: 50)
gataactatggccgcaactatgattatggcatggattat (amino acids)

(SEQ ID NO: 51)
DNYGRNYDYGMDY

Humanized E6 IgG2 heavy chain synthesized by Genescript:
(DNA)

(SEQ ID NO: 52)
gaattctaagcttgggccaccatggaactggggctccgctgggttttccttgttgctattttagaaggtgtcc agtgtgaggtgcagctggtggagtctgggggaggcctggtcaagcctggggggtccctgagactctcctgtgc agcctctggattcaccttcagtaggtatggcatgagctgggtccgccaggctccagggaagaggctggagtgg gtctcaaccattagtggcggaggcacctacatatactacccagactcagtgaagggccgattcaccatctcca gagacaacgccaagaacaccctgtatctgcaaatgaacagcctgagagccgaggacacggctgtgtattactg taccagagataactatggccgcaactatgattatggcatggattattggggccagggcaccctggtgaccgtg agcagcgcctccaccaagggcccatcggtcttccccctggcgccctgctccaggagcacctccgagagcacag ccgcccctgggctgcctggtcaaggactacttccccgaaccggtgacggtgtcgtggaactcaggcgctctgac cagcggcgtgcacaccttcccagctgtcctacagtcctcaggactctactccctcagcagcgtggtgaccgtg ccctccagcaacttcggcacccagacctacacctgcaacgtagatcacaagcccagcaacaccaaggtggaca agacagttgagcgcaaatgttgtgtcgagtgcccaccgtgcccagcaccacctgtggcaggaccgtcagtctt cctcttccccccaaaacccaaggacaccctcatgatctcccggacccctgaggtcacgtgcgtggtggtggac gtgagccacgaagaccccgaggtccagttcaactggtacgtggacggcgtggaggtgcataatgccaagacaa agccacgggaggagcagttcaacagcacgttccgtgtggtcagcgtcctcaccgttgtgcaccaggactggct gaacggcaaggagtacaagtgcaaggtctccaacaaaggcctcccagcccccatcgagaaaaccatctccaaa accaaagggcagccccgagaaccacaggtgtacaccctgcccccatcccgggaggagatgaccaagaaccagg tcagcctgacctgcctggtcaaaggcttctaccccagcgacatcgccgtggagtgggagagcaatgggcagcc ggagaacaactacaagaccacacctcccatgctggactccgacggctccttcttcctctacagcaagctcacc gtggacaagagcaggtggcagcaggggaacgtcttctcatgctccgtgatgcatgaggctctgcacaaccact acacgcagaagagcctctccctgtctccgggtaaatagtaagtttaaactctaga (amino acids)

(SEQ ID NO: 53)
EF*AWATMELGLRWVFLVAILEGVQCEVQLVESGGGLVKPGGSLRLSCAASGFTFSRYGMSWVRQAPGKRLEW

VSTISGGGTYIYYPDSVKGRFTISRDNAKNTLYLQMNSLRAEDTAVYYCTRDNYGRNYDYGMDYWGQGTLVTV

SSASTKGPSVFPLAPCSRSTSESTAALGCLVKDYFPEPVTVSWNSGALTSGVHTFPAVLQSSGLYSLSSVVTV

PSSNFGTQTYTCNVDHKPSNTKVDKTVERKCCVECPPCPAPPVAGPSVFLFPPKPKDTLMISRTPEVTCVVVD

VSHEDPEVQFNWYVDGVEVHNAKTKPREEQFNSTFRVVSVLTVVHQDWLNGKEYKCKVSNKGLPAPIEKTISK

TKGQPREPQVYTLPPSREEMTKNQVSLTCLVKGFYPSDIAVEWESNGQPENNYKTTPPMLDSDGSFFLYSKLT

VDKSRWQQGNVFSCSVMHEALHNHYTQKSLSLSPGK**V*TLX

Human IgG2 heavy chain constant region sequence:
(DNA)

(SEQ ID NO: 54)
gcctccaccaagggcccatcggtcttccccctggcgccctgctccaggagcacctccgagagcacagccgccc tgggctgcctggtcaaggactacttccccgaaccggtgacggtgtcgtggaactcaggcgctctgaccagcgg cgtgcacaccttcccagctgtcctacagtcctcaggactctactccctcagcagcgtggtgaccgtgccctcc agcaacttcggcacccagacctacacctgcaacgtagatcacaagcccagcaacaccaaggtggacaagacag -continued ttgagcgcaaatgttgtgtcgagtgccaccgtgcccagcacctgtggcaggaccgtcagtcttcctctt cccccaaaacccaaggacaccctcatgatctcccggacccctgaggtcacgtgcgtggtggtggacgtgagc cacgaagaccccgaggtccagttcaactggtacgtggacggcgtggaggtgcataatgccaagacaaagccac gggaggagcagttcaacagcacgttccgtgtggtcagcgtcctcaccgttgtgcaccaggactggctgaacgg caaggagtacaagtgcaaggtctccaacaaaggcctcccagcccccatcgagaaaaccatctccaaaaccaaa gggcagccccgagaaccacaggtgtacaccctgcccccatcccgggaggagatgaccaagaaccaggtcagcc tgacctgcctggtcaaaggcttctaccccagcgacatcgccgtggagtgggagagcaatgggcagccggagaa caactacaagaccacacctcccatgctggactccgacggctccttcttcctctacagcaagctcaccgtggac aagagcaggtggcagcaggggaacgtcttctcatgctccgtgatgcatgaggctctgcacaaccactacacgc agaagagcctctccctgtctccgggtaaatag (amino acids)
(SEQ ID NO: 55)
ASTKGPSVFPLAPCSRSTSESTAALGCLVKDYFPEPVTVSWNSGALTSGVHTFPAVLQSSGLYSLSSVVTVPS

SNFGTQTYTCNVDHKPSNTKVDKTVERKCCVECPPCPAPPVAGPSVFLFPPKPKDTLMISRTPEVTCVVVDVS

HEDPEVQFNWYVDGVEVHNAKTKPREEQFNSTFRVVSVLTVVHQDWLNGKEYKCKVSNKGLPAPIEKTISKTK

GQPREPQVYTLPPSREEMTKNQVSLTCLVKGFYPSDIAVEWESNGQPENNYKTTPPMLDSDGSFFLYSKLTVD

KSRWQQGNVFSCSVMHEALHNHYTQKSLSLSPGK

Humanized E6 IgG1 heavy chain sequence:
(DNA)
(SEQ ID NO: 56)
gaggtgcagctggtggagtctgggggaggcctggtcaagcctggggggtccctgagactctcctgtgcagcct ctggattcaccttcagtaggtatggcatgagctgggtccgccaggctccaggaagaggctggagtgggtctc aaccattagtggcggaggcacctacatatactacccagactcagtgaagggccgattcaccatctccagagac aacgccaagaacccactgtatctgcaaatgaacagcctgagagccgaggacacggctgtgtattactgtccca gagataactatggccgcaactatgattatggcatggattattggggccagggcaccctggtgaccgtgagcag cgctagcaccaagggcccatcggtcttccccctggcaccctcctccaagagcacctctgggggcacagcggcc ctgggctgcctggtcaaggactacttccccgaaccggtgacggtgtcgtggaactcaggcgccctgaccagcg gcgtgcacaccttcccggctgtcctacagtcctcaggactctactccctcagcagcgtggtgacagtgccctc cagcagcttgggcacccagacctacatctgcaacgtgaatcacaagcccagcaacaccaaggtggacaagaaa gttgagcccaaatcttgtgacaaaactcacacatgcccaccgtgcccagcacctgaactcctggggggaccgt cagtcttcctcttccccccaaaacccaaggacaccctcatgatctcccggacccctgaggtcacatgcgtggt ggtggacgtgagccacgaagaccctgaggtcaagttcaactggtacgtggacggcgtggaggtgcataatgcc aagacaaagccgcgggaggagcagtacaacagcacgtaccgtgtggtcagcgtcctcaccgtcctgcaccagg actggctgaatggcaaggagtacaagtgcaaggtctccaacaaagccctcccagcccccatcgagaaaaccat ctccaaagccaaagggcagccccgagaaccacaggtgtacaccctgcccccatcccgggaggagatgaccaag aaccaggtcagcctgacctgcctggtcaaaggcttctatcccagcgacatcgccgtggagtgggagagcaatg ggcagccggagaacaactacaagaccacgcctcccgtgctggactccgacggctccttcttcctctacagcaa gctcaccgtggacaagagcaggtggcagcaggggaacgtcttctcatgctccgtgatgcatgaggctctgcac aaccactacacgcagaagagcctctccctgtctccgggtaaatgataa (amino acids)
(SEQ ID NO: 57)
EVQLVESGGGLVKPGGSLRLSCAASGFTFSRYGMSWVRQAPGKRLEWVSTISGGGTYIYYPDSVKGRFTISRD

NAKNPLYLQMNSLRAEDTAVYYCPRDNYGRNYDYGMDYWGQGTLVTVSSASTKGPSVFPLAPSSKSTSGGTAA

LGCLVKDYFPEPVTVSWNSGALTSGVHTFPAVLQSSGLYSLSSVVTVPSSSLGTQTYICNVNHKPSNTKVDKK

-continued

VEPKSCDKTHTCPPCPAPELLGGPSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTISKAKGQPREPQVYTLPPSREEMTK

NQVSLTCLVKGFYPSDIAVEWESNGQPENNYKTTPPVLDSDGSFFLYSKLTVDKSRWQQGNVFSCSVMHEALH

NHYTQKSLSLSPGK**

Human IgG1 heavy chain constant region sequence:
(DNA)
(SEQ ID NO: 58)
gctagcaccaagggcccatcggtcttccccctggcaccctcctccaagagcacctctgggggcacagcggccc tgggctgcctggtcaaggactacttccccgaaccggtgacggtgtcgtggaactcaggcgccctgaccagcgg cgtgcacaccttcccggctgtcctacagtcctcaggactctactccctcagcagcgtggtgacagtgccctcc agcagcttgggcacccagacctacatctgcaacgtgaatcacaagcccagcaacaccaaggtggacaagaaag ttgagcccaaatcttgtgacaaaactcacacatgcccaccgtgcccagcacctgaactcctggggggaccgtc agtcttcctcttccccccaaaacccaaggacaccctcatgatctcccggacccctgaggtcacatgcgtggtg gtggacgtgagccacgaagaccctgaggtcaagttcaactggtacgtggacggcgtggaggtgcataatgcca agacaaagccgcgggaggagcagtacaacagcacgtaccgtgtggtcagcgtcctcaccgtcctgcaccagga ctggctgaatggcaaggagtacaagtgcaaggtctccaacaaagccctcccagcccccatcgagaaaaccatc tccaaagccaaagggcagccccgagaaccacaggtgtacaccctgcccccatcccgggaggagatgaccaaga accaggtcagcctgacctgcctggtcaaaggcttctatcccagcgacatcgccgtggagtgggagagcaatgg gcagccggagaacaactacaagaccacgcctcccgtgctggactccgacggctccttcttcctctacagcaag ctcaccgtggacaagagcaggtggcagcaggggaacgtcttctcatgctccgtgatgcatgaggctctgcaca accactacacgcagaagagcctctccctgtctccgggtaaatgataa (amino acids)
(SEQ ID NO: 59)
ASTKGPSVFPLAPSSKSTSGGTAALGCLVKDYFPEPVTVSWNSGALTSGVHTFPAVLQSSGLYSLSSVVTVPS

SSLGTQTYICNVNHKPSNTKVDKKVEPKSCDKTHTCPPCPAPELLGGPSVFLFPPKPKDTLMISRTPEVTCVV

VDVSHEDPEVKFNWYVDGVEVHNAKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQPENNYKTTPPVLDSDGSFFLYSK

LTVDKSRWQQGNVFSCSVMHEALHNHYTQKSLSLSPGK**

Human IgG1 heavy chain constant region gBLOCK#1 sequence:
(DNA)
(SEQ ID NO: 60)
atggcatggattattggggccagggcaccctggtgaccgtgagcagcgctagcaccaagggcccatcggtctt ccccctggcaccctcctccaagagcacctctgggggcacagcggccctgggctgcctggtcaaggactacttc cccgaaccggtgacggtgtcgtggaactcaggcgccctgaccagcggcgtgcacaccttcccggctgtcctac agtcctcaggactctactccctcagcagcgtggtgacagtgccctccagcagcttgggcacccagacctacat ctgcaacgtgaatcacaagcccagcaacaccaaggtggacaagaaagttgagcccaaatcttgtgacaaaact cacacatgcccaccgtgcccagcacctgaactcctggggggaccgtcagtcttcctcttccccccaaaaccca aggacaccctcatgatctcccggacccctgaggtcacatgcgtggtggtggacgtgagccacgaagaccctga ggtcaagttcaactggtacgtggacggcgtggaggtgcataatgccaag Human IgG1 heavy chain constant region gBLOCK#2 sequence:
(DNA)
(SEQ ID NO: 61)
tacgtggacggcgtggaggtgcataatgccaagacaaagccgcgggaggagcagtacaacagcacgtaccgtg tggtcagcgtcctcaccgtcctgcaccaggactggctgaatggcaaggagtacaagtgcaaggtctccaacaa agccctcccagcccccatcgagaaaaccatctccaaagccaaagggcagccccgagaaccacaggtgtacacc ctgcccccatcccgggaggagatgaccaagaaccaggtcagcctgacctgcctggtcaaaggcttctatccca -continued gcgacatcgccgtggagtgggagagcaatgggcagccggagaacaactacaagaccacgcctcccgtgctgga ctccgacggctccttcttcctctacagcaagctcaccgtggacaagagcaggtggcagcaggggaacgtcttc tcatgctccgtgatgcatgaggctctgcacaaccactacacgcagaagagcctctccctgtctccgggtaaat gataagtttaaacccgctgatcagcctcgactgtgccttctagttg E6 heavy chain variable region overlapping sequence:
(DNA)
(SEQ ID NO: 62)
atggcatggattattggggccagggcaccct IgG1 heavy chain constant region overlapping region sequence:
(DNA)
(SEQ ID NO: 63)
tacgtggacggcgtggaggtgcataatgccaag pCDNA3.1 V5 and pSECTag2 overlapping sequence:
(DNA)
(SEQ ID NO: 64)
ccgctgatcagcctcgactgtgccttctagttg Mouse E6 Light Chain variable region sequence:
(DNA)
(SEQ ID NO: 65)
caaattgttctcacccagtctccagcaatcatgtctgcatctccaggggaggaggtcaccctaacct gcagtgccacctcaagtgtaagttacatacactggttccagcagaggccaggcacttctcccaaact ctggatttatagcacatccaacctggcttctggagtccctgttcgcttcagtggcagtggatatggg acctcttactctctcacaatcagccgaatggaggctgaagatgctgccacttattactgccagcaaa ggagtagttccccattcacgttcggctcggggacaaagttggaaataaaa (amino acids)
(SEQ ID NO: 66)
QIVLTQSPAIMSASPGEEVTLTCSATSSVSYIHWFQQRPGTSPKLWIYSTSNLASGVPVRFSGSGYGTSYSLT
ISRMEAEDAATYYCQQRSSSPFTFGSGTKLEIK Mouse E6 light chain variable framework region 1 (FWR1) sequence:
(DNA)
(SEQ ID NO: 67)
caaattgttctcacccagtctccagcaatcatgtctgcatctccaggggaggaggtcaccctaacctgc (amino acids)
(SEQ ID NO: 68)
QIVLTQSPAIMSASPGEEVTLTC Mouse E6 light chain variable complementarity determining regions 1
(CDR1) sequence:
(DNA)
(SEQ ID NO: 69)
AGTGCCACCTCAAGTGTAAGTTACATACAC (amino acids)
(SEQ ID NO: 70)
SATSSVSYIH Mouse E6 light chain variable framework region 2 (FWR2) sequence:
(DNA)
(SEQ ID NO: 71)
tggttccagcagaggccaggcacttctcccaaactctggatttat (amino acids)
(SEQ ID NO: 72)
WFQQRPGTSPKLWIY Mouse E6 light chain variable complementarity determining regions 2
(CDR2) sequence:
(DNA)
(SEQ ID NO: 73)
agcacatccaacctggcttct (amino acids)
(SEQ ID NO: 74)
STSNLAS Mouse E6 light chain variable framework region 3 (FWR3) sequence:
(DNA)
(SEQ ID NO: 75)
ggagtccctgttcgcttcagtggcagtggatatgggacctcttactctctcacaatcagccgaatggaggctg
aagatgctgccacttattactgc (amino acids)
(SEQ ID NO: 76)
GVPVRFSGSGYGTSYSLTISRMEAEDAATYYC Mouse E6 light chain variable complementarity determining regions 3
(CDR3) sequence:
(DNA)
(SEQ ID NO: 77)
cagcaaaggagtagttccccattcacg
(amino acids)
(SEQ ID NO: 78)
QQRSSSPFT IGKV3-11*02 light chain variable region sequence:
(DNA)
(SEQ ID NO: 79)
gaaattgtgttgacacagtctccagccaccctgtctttgtctccaggggaaagagccaccctctcctgcaggg ccagtcagagtgttagcagctacttagcctggtaccaacagaaacctggccaggctcccaggctcctcatcta tgatgcatccaacagggccactggcatcccagccaggttcagtggcagtgggtctgggagagacttcactctc accatcagcagcctagagcctgaagattttgcagtttattactgtcagcagcgtagcaactggcctcc (amino acids)
(SEQ ID NO: 80)
EIVLTQSPATLSLSPGERATLSCRASQSVSSYLAWYQQKPGQAPRLLIYDASNRATGIPA
RFSGSGSGRDFTLTISSLEPEDFAVYYCQQRSNWPP IGKV3-11*02 light chain variable framework region 1 (FWR1) acid sequence:
(DNA)
(SEQ ID NO: 81)
gaaattgtgttgacacagtctccagccaccctgtctttgtctccaggggaaagagccaccctctcctgc (amino acids)
(SEQ ID NO: 82)
EIVLTQSPATLSLSPGERATLSC IGKV3-11*02 light chain variable complementarity determining regions 1
(CDR1) sequence:
(DNA)
(SEQ ID NO: 83)
agggccagtcagagtgttagcagctacttagcc (amino acids)
(SEQ ID NO: 84)
RASQSVSSYLA IGKV3-11*02 light chain variable framework region 2 (FWR2) sequence:
(DNA)
(SEQ ID NO: 85)
tggtaccaacagaaacctggccaggctcccaggctcctcatctat (amino acids)
(SEQ ID NO: 86)
WYQQKPGQAPRLLIY IGKV3-11*02 light chain variable complementarity determining regions 2
(CDR2) sequence:
(DNA)
(SEQ ID NO: 87)
gatgcatccaacagggccact (amino acids)
(SEQ ID NO: 88)
DASNRAT IGKV3-11*02 light chain variable framework region 3 (FWR3) sequence:
(DNA)
(SEQ ID NO: 89)
ggcatcccagccaggttcagtggcagtgggtctgggagagacttcactctcaccatcagcagcctagagcctg
aagattttgcagtttattactgt (amino acids)

```
                                                      (SEQ ID NO: 90)
GIPARFSGSGSGTDFTLTISSLEPEDFAVYYC

IGKV3-11*02 light chain variable complementarity determining regions3
(CDR3) sequence:
(DNA)
                                                      (SEQ ID NO: 91)
cagcagcgtagcaactggcctcc (amino acids)
                                                      (SEQ ID NO: 92)
QQRSNWPP Humanized E6 light chain variable region sequence:
(DNA)
                                                      (SEQ ID NO: 93)
gaaattgtgttgacacagtctccagccaccctgtctttgtctccaggggaaagagccaccctcacctgcagcg ccaccagcagtgttagctacatccactggtaccaacagaggcctggccagagcccaggctcctcatctatag cacctccaacctggccagcggcatcccagccaggttcagtggcagtgggtctgggagcgactacactctcacc atcagcagcctagagcctgaagattttgcagtttattactgtcagcagcgtagcagctccccttcacctttg gcagcggcaccaaagtggaaattaaa (amino acids)
                                                      (SEQ ID NO: 94)
EIVLTQSPATLSLSPGERATLTCSATSSVSYIHWYQQRPGQSPRLLIYSTSNLASGIPARFSGSGSGSDYTLT
ISSLEPEDFAVYYCQQRSSSPFTFGSGTKVEIK Humanized E6 light chain variable framework region 1 (FWR1) acid
sequence:
(DNA)
                                                      (SEQ ID NO: 95)
gaaattgtgttgacacagtctccagccaccctgtctttgtctccaggggaaagagccaccctcacctgc (amino acids)
                                                      (SEQ ID NO: 96)
EIVLTQSPATLSLSPGERATLTC Humanized E6 light chain variable complementarity determining regions 1
(CDR1) sequence:
(DNA)
                                                      (SEQ ID NO: 97)
agcgccaccagcagtgttagctacatccac (amino acids)
                                                      (SEQ ID NO: 98)
SATSSVSYIH Humanized E6 heavy light variable framework region 2 (FWR2) acid
sequence:
(DNA)
                                                      (SEQ ID NO: 99)
tggtaccaacagaggcctggccagagcccaggctcctcatctat (amino acids)
                                                      (SEQ ID NO: 100)
WYQQRPGQSPRLLIY Humanized E6 light chain variable complementarity determining regions 2
(CDR2) sequence:
(DNA)
                                                      (SEQ ID NO: 101)
agcacctccaacctggccagc (amino acids)
                                                      (SEQ ID NO: 102)
STSNLAS Humanized E6 light chain variable framework region 3 (FWR3) acid
sequence:
(DNA)
                                                      (SEQ ID NO: 103)
ggcatcccagccaggttcagtggcagtgggtctgggagcgactacactctcaccatcagcagcctagagcctg
aactattttgcagtttattactgt (amino acids)
                                                      (SEQ ID NO: 104)
GIPARFSGSGSGSDYTLTISSLEPEDFAVYYC
```

Humanized E6 light chain variable complementarity determining regions 3 (CDR3) sequence:
(DNA)
(SEQ ID NO: 105)
cagcagcgtagcagctccctttcacc (amino acids)
(SEQ ID NO: 106)
QQRSSSPFT Humanized E6 Kappa light chain synthesized by Genescript:
(DNA)
(SEQ ID NO: 107)
gaattctaagcttgggccaccatggaagcccagcgcagcttctcttcctcctgctactctggctcccagata ccactggagaaattgtgttgacacagtctccagccaccctgtctttgtctccaggggaaagagccaccctcac ctgcagcgccaccagcagtgttagctacatccactggtaccaacagaggcctggccagagccccaggctcctc atctatagcacctccaacctggccagcggcatcccagccaggttcagtggcagtgggtctgggagcgactaca ctctcaccatcagcagcctagagcctgaagattttgcagtttattactgtcagcagcgtagcagctccccttt cacctttggcagcggcaccaaagtggaaattaaaaggacggtggctgcaccatctgtcttcatcttcccgcca tctgatgagcagttgaaatctggaactgcctctgttgtgtgcctgctgaataacttctatcccagagaggcca aagtacagtggaaggtggataacgccctccaatcgggtaactcccaggagagtgtcacagagcaggacagcaa ggacagcacctacagcctcagcagcaccctgacgctgagcaaagcagactacgagaaacacaaagtctacgcc tgcgaagtcacccatcagggcctgagctcgcccgtcacaaagagcttcaacaggggagagtgttagtaagttt aaactctaga (amino acids)
(SEQ ID NO: 108)
EF*AWATMEAPAQLLFLLLLWLPDTTGEIVLTQSPATLSLSPGERATLTCSATSSVSYIHWYQQRPGQSPRLL

IYSTSNLASGIPARFSGSGSGSDYTLTISSLEPEDFAVYYCQQRSSSPFTFGSGTKVEIKRTVAAPSVFIFPP

SDEQLKSGTASVVCLLNNFYPREAKVQWKVDNALQSGNSQESVTEQDSKDSTYSLSSTLTLSKADYEKHKVYA

CEVTHQGLSSPVTKSFNRGEC**V*TLX

Human Kappa light chain constant region sequence:
(DNA)
(SEQ ID NO: 109)
aggacggtggctgcaccatctgtcttcatcttcccgccatctgatgagcagttgaaatctggaactgcctctg ttgtgtgcctgctgaataacttctatcccagagaggccaaagtacagtggaaggtggataacgccctccaatc gggtaactcccaggagagtgtcacagagcaggacagcaaggacagcacctacagcctcagcagcaccctgacg ctgagcaaagcagactacgagaaacacaaagtctacgcctgcgaagtcacccatcagggcctgagctcgcccg tcacaaagagcttcaacaggggagagtgttag (amino acids)
(SEQ ID NO: 110)
RTVAAPSVFIFPPSDEQLKSGTASVVCLLNNFYPREAKVQWKVDNALQSGNSQESVTEQDSKDSTYSLSSTLT
LSKADYEKHKVYACEVTHQGLSSPVTKSFNRGEC Humanized E6 lambda light chain sequence:
(DNA)
(SEQ ID NO: 111)
gaaattgtgttgacacagtctccagccaccctgtctttgtctccaggggaaagagccaccctcacctgcagcg ccaccagcagtgttagctacatccactggtaccaacagaggcctggccagagccccaggctcctcatctatag cacctccaacctggccagcggcatcccagccaggttcagtggcagtgggtctgggagcgactacactctcacc atcagcagcctagagcctgaagattttgcagtttattactgtcagcagcgtagcagctccccttttcacctttg gcagcggcaccaaagtggaaattaaaggtcagcccaaggctgccccctcggtcactctgttcccgccctcctc tgaggagcttcaagccaacaaggccacactggtgtgtctcataagtgacttctacccgggagccgtgacagtg gcctggaaggcagatagcagccccgtcaaggcgggagtggagaccaccacaccctccaaacaaagcaacaaca -continued agtacgcggccagcagctatctgagcctgacgcctgagcagtggaagtcccacagaagctacagctgccaggt cacgcatgaagggagcaccgtggagaagacagtggcccctacagaatgttcatagtaa (amino acids)
(SEQ ID NO: 112)
EIVLTQSPATLSLSPGERATLTCSATSSVSYIHWYQQRPGQSPRLLIYSTSNLASGIPARFSGSGSGSDYTLT
ISSLEPEDFAVYYCQQRSSSPFTFGSGTKVEIKGQPKAAPSVTLFPPSSEELQANKATLVCLISDFYPGAVTV
AWKADSSPVKAGVETTTPSKQSNNKYAASSYLSLTPEQWKSHRSYSCQVTHEGSTVEKTVAPTECS**

Humanized lambda light chain constant region sequence:
(DNA)
(SEQ ID NO: 113)
ggtcagcccaaggctgcccccctcggtcactctgttcccgccctcctctgaggagcttcaagccaacaaggcca cactggtgtgtctcataagtgacttctacccgggagccgtgacagtggcctggaaggcagatagcagcccccgt caaggcgggagtggagaccaccacaccctccaaacaaagcaacaacaagtacgcggccagcagctatctgagc ctgacgcctgagcagtggaagtcccacagaagctacagctgccaggtcacgcatgaagggagcaccgtggaga agacagtggcccctacagaatgttcatagtaa (amino acids)
(SEQ ID NO: 114)
GQPKAAPSVTLFPPSSEELQANKATLVCLISDFYPGAVTVAWKADSSPVKAGVETTTPSKQSNNKYAASSYLS
LTPEQWKSHRSYSCQVTHEGSTVEKTVAPTECS**

Human lambda light chain constant region gBLOCK#3 sequence:
(DNA)
(SEQ ID NO: 115)
agcgccaccagcagtgttagctacatccactggtaccaacagaggcctggccagagccccaggctcctcatct atagcacctccaacctggccagcggcatcccagccaggttcagtggcagtgggtctgggagcgactacactct caccatcagcagcctagagcctgaagattttgcagtttattactgtcagcagcgtagcagctcccctttcacc tttggcagcggcaccaaagtggaaattaaaggtcagcccaaggctgcccccctcggtcactctgttcccgccct cctctgaggagcttcaagccaacaaggccacactggtgtgtctcataagtgacttctacccgggagccgtgac agtggcctggaaggcagatagcagcccccgtcaaggcgggagtggagaccaccacaccctccaaacaaagcaac aacaagtacgcggccagcagctatctgagcctgacgcctgagcagtggaagtcccacagaagctacagctgcc aggtcacgcatgaagggagcaccgtggagaagacagtggcccctacagaatgttcatagtaagtttaaacccg ctgatcagcctcgactgtgccttctagttg E6 light chain variable region overlapping sequence:
(DNA)
(SEQ ID NO: 116)
agcgccaccagcagtgttagctacatccact pCDNA3.1 V5 and pSECTag2 overlapping sequence:
(DNA)
(SEQ ID NO: 117)
ccgctgatcagcctcgactgtgccttctagttg Mouse C2 heavy chain variable region sequence:
(DNA)
(SEQ ID NO: 118)
gaggtccagctggaggagtcaggggaggcttagtgaagcctggagggtccctgaaactctcctgtgcagcct ctggattcactttcagtggctatgccatgtcttgggttcgccagactccggagaagaggctggagtgggtcgc aaccattagtagtggtggtacttatatctactatccagacagtgtgaaggggcgattcaccatctccagagac aatgccaagaacaccctgtacctgcaaatgagcagtctgaggtctgaggacacggccatgtattactgtgcaa gacttggggggataattactacgaatacttcgatgtctggggcgcagggaccacggtcaccgtctcctccgc caaaacgacacccccatctgtctat (amino acids)
(SEQ ID NO: 119)
EVQLEESGGGLVKPGGSLKLSCAASGFTFSGYAMSWVRQTPEKRLEWVATISSGGTYIYYPDSVKGRFTISRD
NAKNTLYLQMSSLRSEDTAMYYCARLGGDNYYEYFDVWGAGTTVTVSSAKTTPPSVY Mouse C2 heavy chain variable framework region 1 (FWR1) sequence:
(DNA)
(SEQ ID NO: 120)
gaggtccagctggaggagtcaggggggaggcttagtgaagcctggagggtccctgaaactctcctgtgcagcct
ctggattcactttcagt (amino acids)
(SEQ ID NO: 121)
EVQLEESGGGLVKPGGSLKLSCAASGFTFS Mouse C2 heavy chain variable complementarity determining regions 1
(CDR1) sequence:
(DNA)
(SEQ ID NO: 122)
ggctatgccatgtct (amino acids)
(SEQ ID NO: 123)
GYAMS Mouse C2 heavy chain variable framework region 2 (FWR2) sequence:
(DNA)
(SEQ ID NO: 124)
tgggttcgccagactccggagaagaggctggagtgggtcgca (amino acids)
(SEQ ID NO: 125)
WVRQTPEKRLEWVA Mouse C2 heavy chain variable complementarity determining regions 2
(CDR2) sequence:
(DNA)
(SEQ ID NO: 126)
accattagtagtggtggtacttatatctactatccagacagtgtgaagggg (amino acids)
(SEQ ID NO: 127)
TISSGGTYIYYPDSVKG Mouse C2 heavy chain variable framework region 3 (FWR3) sequence:
(DNA)
(SEQ ID NO: 128)
cgattcaccatctccagagacaatgccaagaacaccctgtacctgcaaatgagcagtctgaggtctgaggaca
cggccatgtattactgtgcaaga (amino acids)
(SEQ ID NO: 129)
RFTISRDNAKNTLYLQMSSLRSEDTAMYYCAR Mouse C2 heavy chain variable complementarity determining regions 3
(CDR3) sequence:
(DNA)
(SEQ ID NO: 130)
cttggggggataattactacgaatacttcgatgtc (amino acids)
(SEQ ID NO: 131)
LGGDNYYEYFDV IGHV3-21*04 heavy chain variable region sequence:
(DNA)
(SEQ ID NO: 132)
gaggtgcagctggtggagtctgggggaggcctggtcaagcctggggggtccctgagactctcctgtgcagcct ctggattcaccttcagtagctatagcatgaactgggtccgccaggctccagggaaggggctggagtgggtctc atccattagtagtagtagtagttacatatactacgcagactcagtgaagggccgattcaccatctccagagac aacgccaagaactcactgtatctgcaaatgaacagcctgagagccgaggacacggccgtgtattactgtgcga ga (amino acids)
(SEQ ID NO: 133)
EVQLVESGGGLVKPGGSLRLSCAASGFTFSSYSMNWVRQAPGKGLEWVSSISSSSSYIYYADSVKGRFTISRD
NAKNSLYLQMNSLRAEDTAVYYCAR IGHV3-21*04 heavy chain variable framework region 1 (FWR1) sequence:
(DNA)
(SEQ ID NO: 134)
gaggtgcagctggtggagtctggggggaggcctggtcaagcctggggggtccctgagactctcctgtgcagcct
ctggattcaccttcagt (amino acids)
(SEQ ID NO: 135)
EVQLVESGGGLVKPGGSLRLSCAASGFTFS IGHV3-21*04 heavy chain variable complementarity determining regions 1
(CDR1) sequence:
(DNA)
(SEQ ID NO: 136)
agctatagcatgaac (amino acids)
(SEQ ID NO: 137)
SYSMN IGHV3-21*04 heavy chain variable framework region 2 (FWR2) sequence:
(DNA)
(SEQ ID NO: 138)
gggtccgccaggctccagggaaggggctggagtgggtctca (amino acids)
(SEQ ID NO: 139)
WVRQAPGKGLEWVS IGHV3-21*04 heavy chain variable complementarity determining regions 2
(CDR2) sequence:
(DNA)
(SEQ ID NO: 140)
tccattagtagtagtagtagttacatatactacgcagactcagtgaagggc (amino acids)
(SEQ ID NO: 141)
SISSSSSYIYYADSVKG IGHV3-21*04 heavy chain variable framework region 3 (FWR3) sequence:
(DNA)
(SEQ ID NO: 142)
cgattcaccatctccagagacaacgccaagaactcactgtatctgcaaatgaacagcctgagagccgaggaca
cggccgtgtattactgtgcgaga (amino acids)
(SEQ ID NO: 143)
RFTISRDNAKNSLYLQMNSLRAEDTAVYYCAR Humanized C2 heavy chain variable region sequence:
(DNA)
(SEQ ID NO: 144)
gaggtgcagctggtggagtctggggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccccgactcagtgaagggccgattcaccatctccagagac aacgccaagaactcactgtatctgcaaatgaacagcctgagagccgaggacacggccgtgtattactgtgcga gacttggggggataattactacgaatacttcgatgtctggggcaaagggaccacggtcaccgtctcctcc (amino acids)
(SEQ ID NO: 145)
EVQLVESGGGLVKPGGSLRLSCAASGFTFSGYAMSWVRQAPGKGLEWVSTISSGGTYIYYPDSVKGRFTISRD
NAKNSLYLQMNSLRAEDTAVYYCARLGGDNYYEYFDVWGKGTTVTVSS Humanized C2 heavy chain variable framework region 1 (FWR1) sequence:
(DNA)
(SEQ ID NO: 146)
gaggtgcagctggtggagtctggggggaggcctggtcaagcctggggggtccctgagactctcctgtgcagcct
ctggattcaccttcagt (amino acids)
(SEQ ID NO: 147)
EVQLVESGGGLVKPGGSLRLSCAASGFTFS Humanized C2 heavy chain variable complementarity determining regions 1
(CDR1) sequence:
(DNA)
(SEQ ID NO: 148)
ggctatgccatgagc (amino acids)
(SEQ ID NO: 149)
GYAMS Humanized C2 heavy chain variable framework region 2 (FWR2) sequence:
(DNA)
(SEQ ID NO: 150)
tgggtccgccaggctccagggaaggggctggagtgggtctcaa (amino acids)
(SEQ ID NO: 151)
WVRQAPGKGLEWVS Humanized C2 heavy chain variable complementarity determining regions 2
(CDR2) sequence:
(DNA)
(SEQ ID NO: 152)
accattagtagtggcggaacctacatatactaccccgactcagtgaagggc (amino acids)
(SEQ ID NO: 153)
TISSGGTYIYYPDSVKG Humanized C2 heavy chain variable framework region 3 (FWR3) sequence:
(DNA)
(SEQ ID NO: 154)
cgattcaccatctccagagacaacgccaagaactcactgtatctgcaaatgaacagcctgagagccgaggaca
cggccgtgtattactgtgcgaga (amino acids)
(SEQ ID NO: 155)
RFTISRDNAKNSLYLQMNSLRAEDTAVYYCAR Humanized C2 heavy chain variable complementarity determining regions 3
(CDR3) sequence:
(DNA)
(SEQ ID NO: 156)
cttggggggataattactacgaatacttcgatgtc (amino acids)
(SEQ ID NO: 157)
LGGDNYYEYFDV Humanized C2 IgG1 heavy chain sequence
(DNA)
(SEQ ID NO: 157)
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccccgactcagtgaagggccgattcaccatctccagagac aacgccaagaactcactgtatctgcaaatgaacagcctgagagccgaggacacggccgtgtattactgtgcga gacttggggggataattactacgaatacttcgatgtctggggcaaagggaccacggtcaccgtctcctccgc tagcaccaagggcccatcggtcttccccctggcaccctcctccaagagcacctctgggggcacagcggccctg ggctgcctggtcaaggactacttccccgaaccggtgacggtgtcgtggaactcaggcgccctgaccagcggcg tgcacaccttcccggctgtcctacagtcctcaggactctactccctcagcagcgtggtgacagtgccctccag cagcttgggcacccagacctacatctgcaacgtgaatcacaagcccagcaacaccaaggtggacaagaaagtt gagcccaaatcttgtgacaaaactcacacatgcccaccgtgcccagcacctgaactcctggggggaccgtcag tcttcctcttccccccaaaacccaaggacaccctcatgatctcccggacccctgaggtcacatgcgtggtggt ggacgtgagccacgaagaccctgaggtcaagttcaactggtacgtggacggcgtggaggtgcataatgccaag acaaagccgcgggaggagcagtacaacagcacgtaccgtgtggtcagcgtcctcaccgtcctgcaccaggact ggctgaatggcaaggagtacaagtgcaaggtctccaacaaagccctcccagcccccatcgagaaaaccatctc caaagccaaagggcagccccgagaaccacaggtgtacaccctgcccccatcccgggaggagatgaccaagaac -continued caggtcagcctgacctgcctggtcaaaggcttctatcccagcgacatcgccgtggagtgggagagcaatgggc agccggagaacaactacaagaccacgcctcccgtgctggactccgacggctccttcttcctctacagcaagct caccgtggacaagagcaggtggcagcaggggaacgtcttctcatgctccgtgatgcatgaggctctgcacaac cactacacgcagaagagcctctccctgtctccgggtaaatgataa (amino acids)

(SEQ ID NO: 158)
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYFDVWGKGTTVTVSSASTKGPSVFPLAPSSKSTSGGTAAL

GCLVKDYFPEPVTVSWNSGALTSGVHTFPAVLQSSGLYSLSSVVTVPSSSLGTQTYICNVNHKPSNTKVDKKV

EPKSCDKTHTCPPCPAPELLGGPSVFLFPPKPKDTLMISRTPEVTCVVVDVSHEDPEVKFNWYVDGVEVHNAK

TKPREEQYNSTYRVVSVLTVLHQDWLNGKEYKCKVSNKALPAPIEKTISKAKGQPREPQVYTLPPSREEMTKN

QVSLTCLVKGFYPSDIAVEWESNGQPENNYKTTPPVLDSDGSFFLYSKLTVDKSRWQQGNVFSCSVMHEALHN

HYTQKSLSLSPGK**

Humanized C2 gBLOCK#4 sequence:
(DNA)

(SEQ ID NO: 160)
actcactatagggagacccaagctggctagttaagcttgggccaccatggagacagacacactcctgctatgg gtactgctgctctggggttccaggttccactggtgacgaggtgcagctggtggagtctgggggaggcctggtca agcctggggggtccctgagactctcctgtgcagcctctggattcaccttcagtggctatgccatgagctgggt ccgccaggctccagggaaggggctggagtgggtctcaaccattagtagtggcggaacctacatatactacccc gactcagtgaagggccgattcaccatctccagagacaacgccaagaactcactgtatctgcaaatgaacagcc tgagagccgaggacacggccgtgtattactgtgcgagacttggggggataattactacgaatacttcgatgt ctggggcaaagggaccacggtcaccgtctcctccgctagcaccaagggcccatcggtcttccccctggcaccc tcctccaagagcacctctggggcacagcggccctgggctgcctggtcaaggactacttccccgaaccggtga cggtgtcgtggaactcaggcgccctgaccagc pCDNA3.1 V5 overlapping sequence:
(DNA)

(SEQ ID NO: 161)
actcactatagggagacccaagctggctagtt

Human IgG1 constant region overlapping sequence:
(DNA)

(SEQ ID NO: 162)
gacggtgtcgtggaactcaggcgccctgaccagc

Humanized C2 IgG2 heavy chain sequence
(DNA)

(SEQ ID NO: 163)
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccccgactcagtgaagggccgattcaccatctccagagac aacgccaagaactcactgtatctgcaaatgaacagcctgagagccgaggacacggccgtgtattactgtgcga gacttggggggataattactacgaatacttcgatgtctggggcaaagggaccacggtcaccgtctcctccgc ctccaccaagggcccatcggtcttccccctggcgccctgctccaggagcacctccgagagcacagccgccctg ggctgcctggtcaaggactacttccccgaaccggtgacggtgtcgtggaactcaggcgctctgaccagcggcg tgcacaccttcccagctgtcctacagtcctcaggactctactccctcagcagcgtggtgaccgtgccctccag caacttcggcacccagacctacacctgcaacgtagatcacaagcccagcaacaccaaggtggacaagacagtt gagcgcaaatgttgtgtcgagtgcccaccgtgcccagcaccacctgtggcaggaccgtcagtcttcctcttcc ccccaaaacccaaggacaccctcatgatctcccggacccctgaggtcacgtgcgtggtggtggacgtgagcca -continued

```
cgaagaccccgaggtccagttcaactggtacgtggacggcgtggaggtgcataatgccaagacaaagccacgg gaggagcagttcaacagcacgttccgtgtggtcagcgtcctcaccgttgtgcaccaggactggctgaacggca aggagtacaagtgcaaggtctccaacaaaggcctcccagcccccatcgagaaaaccatctccaaaaccaaagg gcagccccgagaaccacaggtgtacaccctgcccccatcccgggaggagatgaccaagaaccaggtcagcctg acctgcctggtcaaaggcttctaccccagcgacatcgccgtggagtgggagagcaatgggcagccggagaaca actacaagaccacacctcccatgctggactccgacggctccttcttcctctacagcaagctcaccgtggacaa gagcaggtggcagcaggggaacgtcttctcatgctccgtgatgcatgaggctctgcacaaccactacacgcag aagagcctctccctgtctccgggtaaatagtaa
```

(amino acids)

(SEQ ID NO: 164)

```
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYFDVWGKGTTVTVSSASTKGPSVFPLAPCSRSTSESTAAL

GCLVKDYFPEPVTVSWNSGALTSGVHTFPAVLQSSGLYSLSSVVTVPSSNFGTQTYTCNVDHKPSNTKVDKTV

ERKCCVECPPCPAPPVAGPSVFLFPPKPKDTLMISRTPEVTCVVVDVSHEDPEVQFNWYVDGVEVHNAKTKPR

EEQFNSTFRVVSVLTVVHQDWLNGKEYKCKVSNKGLPAPIEKTISKTKGQPREPQVYTLPPSREEMTKNQVSL

TCLVKGFYPSDIAVEWESNGQPENNYKTTPPMLDSDGSFFLYSKLTVDKSRWQQGNVFSCSVMHEALHNHYTQ

KSLSLSPGK**
```

Humanized C2 gBLOCK#5 sequence:
(DNA)

(SEQ ID NO: 165)

```
tgctctgggttccaggttccactggtgacgcggcccagccggccgaggtgcagctggtggagtctggggagg cctggtcaagcctgggggtccctgagactctcctgtgcagcctctggattcaccttcagtggctatgccatg agctgggtccgccaggctccagggaaggggctggagtgggtctcaaccattagtagtggcggaacctacatat actaccccgactcagtgaagggccgattcaccatctccagagacaacgccaagaactcactgtatctgcaaat gaacagcctgagagccgaggacacggccgtgtattactgtgcgagacttgggggggataattactacgaatac ttcgatgtctggggcaaagggaccacggtcaccgtctcctccgcctccaccaagggcccatcggtcttccccc tggcgccctgctccaggagcacctccgagagcacagccgccctgggctgcctggtcaaggactacttccccga accggtgacggtgtcgtggaactcaggcgctctgacca
``` pSEC Tag2 overlapping sequence:
(DNA)

(SEQ ID NO: 166)

tgctctgggttccaggttccactggtgacgc

Human IgG2 constant region overlapping sequence:
(DNA)

(SEQ ID NO: 167)

gacggtgtcgtggaactcaggcgctctgacca

Mouse C2 light chain variable region sequence:
(DNA)

(SEQ ID NO: 168)

```
gacattgtgatcacacagtctacagcttccttaggtgtatctctggggcagagggccaccatctcatgcaggg ccagcaaaagtgtcagtacatctggctatagttatatgcactggtaccaacagagaccaggacagccacccaa actcctcatctatcttgcatccaacctagaatctggggtccctgccaggttcagtggcagtgggtctgggaca gacttcaccctcaacatccatcctgtggaggaggaggatgctgcaacctattactgtcagcacagtagggagc ttccgttcacgttcggagggggaccaagctggagataaaacgggctgatgctgcaccaactgtatcc
```

(amino acids)

(SEQ ID NO: 169)

```
DIVITQSTASLGVSLGQRATISCRASKSVSTSGYSYMHWYQQRPGQPPKLLIYLASNLESGVPARFSGSGSGT

DFTLNIHPVEEEDAATYYCQHSRELPFTFGGGTKLEIKRADAAPTVS
```

Mouse C2 light chain variable framework region 1 (FWR1) sequence:
(DNA)
(SEQ ID NO: 170)
gacattgtgatcacacagtctacagcttccttaggtgtatctctggggcagagggccaccatctcatgc (amino acids)
(SEQ ID NO: 171)
DIVITQSTASLGVSLGQRATISC Mouse C2 light chain variable complementarity determining regions 1
(CDR1) sequence:
(DNA)
(SEQ ID NO: 172)
agggccagcaaaagtgtcagtacatctggctatagttatatgcac (amino acids)
(SEQ ID NO: 173)
RASKSVSTSGYSYMH Mouse C2 light chain variable framework region 2 (FWR2) sequence:
(DNA)
(SEQ ID NO: 174)
tggtaccaacagagaccaggacagccacccaaactcctcatctat (amino acids)
(SEQ ID NO: 175)
WYQQRPGQPPKLLIY Mouse C2 light chain variable complementarity determining regions 2
(CDR2) sequence:
(DNA)
(SEQ ID NO: 176)
cttgcatccaacctagaatc (amino acids)
(SEQ ID NO: 177)
LASNLES Mouse C2 light chain variable framework region 3 (FWR3) sequence:
(DNA)
(SEQ ID NO: 178)
tggggtccctgccaggttcagtggcagtgggtctgggacagacttcaccctcaacatccatcctgtggaggag
gaggatgctgcaacctattactgt (amino acids)
(SEQ ID NO: 179)
GVPARFSGSGSGTDFTLNIHPVEEEDAATYYC Mouse C2 light chain variable complementarity determining regions 3
(CDR3) sequence:
(DNA)
(SEQ ID NO: 180)
cagcacagtagggagcttccgttcacg (amino acids)
(SEQ ID NO: 181)
QHSRELPFT IGKV7-3*01 light chain variable region sequence:
(DNA)
(SEQ ID NO: 182)
gacattgtgctgacccagtctccagcctccttggccgtgtctccaggacagagggccaccatcacctgcagag ccagtgagagtgtcagtttcttgggaataaacttaattcactggtatcagcagaaaccaggacaacctcctaa actcctgatttaccaagcatccaataaagacactggggtcccagccaggttcagcggcagtgggtctgggacc gatttcacccctcacaattaatcctgtggaagctaatgatactgcaaattattactgtctgcagagtaagaatt ttcctcccaca (amino acid)
(SEQ ID NO: 183)
DIVLTQSPASLAVSPGQRATITCRASESVSFLGINLIHWYQQKPGQPPKLLIYQASNKDTGVPARFSGSGSGT
DFTLTINPVEANDTANYYCLQSKNFPPT -continued IGKV7-3*01 light chain variable framework region 1 (FWR1) sequence:
(DNA)
(SEQ ID NO:184)
gacattgtgctgacccagtctccagcctccttggccgtgtctccaggacagagggccaccatcacctgc (amino acids)
(SEQ ID NO: 185)
DIVLTQSPASLAVSPGQRATITC IGKV7-3*01 light chain variable complementarity determining regions 1
(CDR1) sequence:
(DNA)
(SEQ ID NO: 186)
agagccagtgagagtgtcagtttcttgggaataaacttaattcac (amino acids)
(SEQ ID NO:187)
RASESVSFLGINLIH IGKV7-3*01 light chain variable framework region 2 (FWR2) sequence:
(DNA)
(SEQ ID NO: 188)
tggtatcagcagaaaccaggacaacctcctaaactcctgatttac (amino acids)
(SEQ ID NO: 189)
WYQQKPGQPPKLLIY IGKV7-3*01 light chain variable complementarity determining regions 2
(CDR2) sequence:
(DNA)
(SEQ ID NO: 190)
caagcatccaataaagacact (amino acids)
(SEQ ID NO: 191)
QASNKDT IGKV7-3*01 light chain variable framework region 3 (FWR3) sequence:
(DNA)
(SEQ ID NO: 192)
ggggtcccagccaggttcagcggcagtgggtctgggaccgatttcaccctcacaattaatcctgtggaagcta
atgatactgcaaattattactgt (amino acids)
(SEQ ID NO: 193)
GVPARFSGSGSGTDFTLTINPVEANDTANYYC Humanized C2 light chain variable region sequence:
(DNA)
(SEQ ID NO: 194)
gacattgtgctgacccagtctccagcctccttggccgtgtctccaggacagagggccaccatcacctgcagag ccagtaagagtgtcagtaccagcggatactcctacatgcactggtatcagcagaaaccaggacaacctcctaa actcctgatttacctggcatccaatctggagagcggggtcccagccaggttcagcggcagtgggtctgggacc gatttcaccctcacaattaatcctgtggaagctaatgatactgcaaattattactgtcagcacagtagggagc tgccttttcacattcggcggagggaccaaggtggagatcaaacgaact (amino acids)
(SEQ ID NO: 195)
DIVLTQSPASLAVSPGQRATITCRASKSVSTSGYSYMHWYQQKPGQPPKLLIYLASNLESGVPARFSGSGSGT
DFTLTINPVEANDTANYYCQHSRELPFTFGGGTKVEIKRT Humanized C2 light chain variable framework region 1 (FWR1) acid
sequence:
(DNA)
(SEQ ID NO: 196)
gacattgtgctgacccagtctccagcctccttggccgtgtctccaggacagagggccaccatcacctgc (amino acids)
(SEQ ID NO: 197)
DIVLTQSPASLAVSPGQRATITC -continued Humanized C2 light chain variable complementarity determining regions 1 (CDR1) sequence:
(DNA)
(SEQ ID NO: 198)
agagccagtaagagtgtcagtaccagcggatactcctacatgcac (amino acids)
(SEQ ID NO: 199)
RASKSVSTSGYSYMH Humanized C2 heavy light variable framework region 2 (FWR2) acid sequence:
(DNA)
(SEQ ID NO: 200)
tggtatcagcagaaaccaggacaacctcctaaactcctgatttac (amino acids)
(SEQ ID NO: 201)
WYQQKPGQPPKLLIY Humanized C2 light chain variable complementarity determining regions 2 (CDR2) sequence:
(DNA)
(SEQ ID NO: 202)
ctggcatccaatctggagagc (amino acids)
(SEQ ID NO: 203)
LASNLES Humanized C2 light chain variable framework region 3 (FWR3) acid sequence:
(DNA)
(SEQ ID NO: 204)
ggggtcccagccaggttcagcggcagtgggtctgggaccgatttcaccctcacaattaatcctgtggaagctaatgatactgcaaattattactgt (amino acids)
(SEQ ID NO: 205)
GVPARFSGSGSGTDFTLTINPVEANDTANYYC Humanized C2 light chain variable complementarity determining regions 3 (CDR3) sequence:
(DNA)
(SEQ ID NO: 206)
cagcacagtagggagctgcctttcaca (amino acids)
(SEQ ID NO: 207)
QHSRELPFT Humanized C2 light chain variable complementarity determining regions 3 (CDR3) sequence:
(DNA)
(SEQ ID NO: 208)
ctgcagagtaagaattttcctcccaca (amino acids)
(SEQ ID NO: 209)
LQSKNFPPT Humanized C2 gBLOCK#6 sequence (Kappa light chain in pCDNA3.1 V5):
(DNA)
(SEQ ID NO: 210)
actcactatagggagacccaagctggctagttaagcttgggccaccatggagacagacacactcctgctatgg gtactgctgctctgggttccaggttccactggtgacgacattgtgctgacccagtctccagcctccttggccg tgtctccaggacagagggccaccatcacctgcagagccagtaagagtgtcagtaccagcggatactcctacat gcactggtatcagcagaaaccaggacaacctcctaaactcctgatttacctggcatccaatctggagagcggg gtcccagccaggttcagcggcagtgggtctgggaccgatttcaccctcacaattaatcctgtggaagctaatg atactgcaaattattactgtcagcacagtagggagctgcctttcacattcggcggagggaccaaggtggagat caaacgaactacgtggctgcaccatctgtcttcatcttcccgccatctgatgagcagttgaaatctggaact gcctctgttgtgtgcctgctgaataacttctatcccagagaggccaaagtacagtggaaggtggataacgccc -continued tccaatcgggtaactcccaggagagtgtcacagagcaggacagcaaggacagcacctacagcctcagcagcac cctgacgctgagcaaagcagactacgagaaacacaaagtctacgcctgcgaagtcacccatcagggcctgagc tcgcccgtcacaaagagcttcaacaggggagagtgttagtaagtttaaacccgctgatcagcctcgactgtgc cttctagttg pCDNA3.1 V5 5' overlapping sequence:
(DNA)
(SEQ ID NO: 211)
actcactatagggagacccaagctggctagtt pCDNA3.1 V5 3' overlapping sequence:
(DNA)
(SEQ ID NO: 212)
ccgctgatcagcctcgactgtgccttctagttg Humanized C2 gBLOCK#7 sequence (Kappa light chain in pSEC Tag2):
(DNA)
(SEQ ID NO: 213)
tgctctgggttccaggttccactggtgacgcggcccagccggccgacattgtgctgacccagtctccagcctc cttggccgtgtctccaggacagagggccaccatcacctgcagagccagtaagagtgtcagtaccagcggatac tcctacatgcactggtatcagcagaaaccaggacaacctcctaaactcctgatttacctggcatccaatctgg agagcggggtcccagccaggttcagcggcagtgggtctgggaccgatttcaccctcacaattaatcctgtgga agctaatgatactgcaaattattactgtcagcacagtagggagctgccttcacattcggcggagggaccaag gtggagatcaaacgaactacggtggctgcaccatctgtcttcatcttcccgccatctgatgagcagttgaaat ctggaactgcctctgttgtgtgcctgctgaataacttctatcccagagaggccaaagtacagtggaaggtgga taacgcccctccaatcgggtaactcccaggagagtgtcacagagcaggacagcaaggacagcacctacagcctc agcagcaccctgacgctgagcaaagcagactacgagaaacacaaagtctacgcctgcgaagtcacccatcagg gcctgagctcgcccgtcacaaagagcttcaacaggggagagtgttagtaagtttaaacccgctgatcagcctc gactgtgccttctagttg pSEC Tag2 5' overlapping sequence:
(DNA)
(SEQ ID NO: 214)
tgctctgggttccaggttccactggtgacgc pSEC Tag2 3' overlapping sequence:
(DNA)
(SEQ ID NO: 215)
ccgctgatcagcctcgactgtgccttctagttg Humanized C2 gBLOCK#8 sequence (lambda light chain in pCDNA3.1 V5):
(DNA)
(SEQ ID NO: 216)
actcactatagggagacccaagctggctagttaagcttgggccaccatggagacagacacactcctgctatgg gtactgctgctctgggttccaggttccactggtgacgacattgtgctgacccagtctccagcctccttggccg tgtctccaggacagagggccaccatcacctgcagagccagtaagagtgtcagtaccagcggatactcctacat gcactggtatcagcagaaaccaggacaacctcctaaactcctgatttacctggcatccaatctggagagcggg gtcccagccaggttcagcggcagtgggtctgggaccgatttcaccctcacaattaatcctgtggaagctaatg atactgcaaattattactgtcagcacagtagggagctgccttcacattcggcggagggaccaaggtggagat caaacgaactggtcagcccaaggctgccccctcggtcactctgttcccgccctcctctgaggagcttcaagcc aacaaggccacactggtgtgtctcataagtgacttctacccgggagccgtgacagtggcctggaaggcagata gcagccccgtcaaggcgggagtggagaccaccacacccctccaaacaaagcaacaacaagtacgcggccagcag ctatctgagcctgacgcctgagcagtggaagtcccacagaagctacagctgccaggtcacgcatgaagggagc accgtggagaagacagtggcccctacagaatgttcatagtaagtttaaacccgctgatcagcctcgactgtgc cttctagttg pCDNA3.1 V5 5' overlapping sequence:
(DNA)
(SEQ ID NO: 217)
actcactatagggagacccaagctggctagtt pCDNA3.1 V5 3' overlapping sequence:
(DNA)
(SEQ ID NO: 218)
ccgctgatcagcctcgactgtgccttctagttg Humanized C2 gBLOCK#9 sequence (lambda light chain in pSEC Tag2):
(DNA)
(SEQ ID NO: 219)
tgctctgggttccaggttccactggtgacgcggcccagccggccgacattgtgctgacccagtctccagcctc cttggccgtgtctccaggacagagggccaccatcacctgcagagccagtaagagtgtcagtaccagcggatac tcctacatgcactggtatcagcagaaaccaggacaacctcctaaactcctgatttacctggcatccaatctgg agagcggggtcccagccaggttcagcggcagtgggtctgggaccgatttcaccctcacaattaatcctgtgga agctaatgatactgcaaattattactgtcagcacagtagggagctgcctttcacattcggcggagggaccaag gtggagatcaaacgaactggtcagcccaaggctgccccctcggtcactctgttcccgccctcctctgaggagc ttcaagccaacaaggccacactggtgtgtctcataagtgacttctacccgggagccgtgacagtggcctggaa ggcagatagcagccccgtcaaggcgggagtggagaccaccacaccctccaaacaaagcaacaacaagtacgcg gccagcagctatctgagcctgacgcctgagcagtggaagtcccacagaagctacagctgccaggtcacgcatg aagggagcaccgtggagaagacagtggcccctacagaatgttcatagtaagtttaaacccgctgatcagcctc gactgtgccttctagttg pSEC Tag2 5' overlapping sequence:
(DNA)
(SEQ ID NO: 220)
tgctctgggttccaggttccactggtgacgc pSEC Tag2 3' overlapping sequence:
(DNA)
(SEQ ID NO: 221)
ccgctgatcagcctcgactgtgccttctagttg Murine Ig kappa chain leader sequence
(DNA)
(SEQ ID NO: 222)
atggagacagacacactcctgctatgggtactgctgctctgggttccaggttccactggtgac (amino acids)
(SEQ ID NO: 223)
METDTLLLWVLLLWVPGSTGD Interleukin-2 (IL-2) leader sequence
(DNA)
(SEQ ID NO: 224)
atgtacaggatgcaactcctgtcttgcattgcactaagtcttgcacttgtcacaaacagt (amino acids)
(SEQ ID NO: 225)
MYRMQLLSCIALSLALVTNS CD33 leader sequence
(DNA)
(SEQ ID NO: 226)
atgcctcttctgcttctgcttcctctgctttgggctggagctcttgct (amino acids)
(SEQ ID NO: 227)
MPLLLLLPLLWAGALA IGHV3-21*03 leader sequence
(DNA)
(SEQ ID NO: 228)
atggaactggggctccgctgggttttccttgttgctattttagaaggtgtccagtgt (amino acids)
(SEQ ID NO: 229)
MELGLRWVFLVAILEGVQC IGHV3-11*02 leader sequence
(DNA)
(SEQ ID NO: 230)
atggaagccccagcgcagcttctcttcctcctgctactctggctcccagataccactgga (amino acids)
(SEQ ID NO: 231)
MEAPAQLLFLLLLWLPDTTG Humanized E6 single chain GS3
(DNA)
(SEQ ID NO: 232)
gaggtgcagctggtggagtctggggagggcctggtcaagcctggggggtccctgagactctcctgtg cagcctctggattcaccttcagtaggtatggcatgagctgggtccgccaggctccagggaagaggct ggagtgggtctcaaccattagtggcggaggcacctacatatactacccagactcagtgaagggccga ttcaccatctccagagacaacgccaagaacaccctgtatctgcaaatgaacagcctgagagccgagg acacggctgtgtattactgtaccagagataactatggccgcaactatgattatggcatggattattg gggccagggcaccctggtgaccgtgagcagcggcggtggcggatccggcggtggcggatccggcggt ggcggatccgaaattgtgttgacacagtctccagccaccctgtctttgtctccaggggaaagagcca ccctcacctgcagcgccaccagcagtgttagctacatccactggtaccaacagaggcctggccagag ccccaggctcctcatctatagcacctccaacctggccagcggcatcccagccaggttcagtggcagt gggtctgggagcgactacactctcaccatcagcagcctagagcctgaagattttgcagtttattact gtcagcagcgtagcagctccccttttacctttggcagcggcaccaaagtggaaattaaa (amino acids)
(SEQ ID NO: 233)
EVQLVESGGGLVKPGGSLRLSCAASGFIFSRYGMSWVRQAPGKRLEWVSTISGGGIYIYYPDSVKGRFTISRD

NAKNTLYLQMNSLRAEDTAVYYCIRDNYGRNYDYGMDYWGQGTLVIVSSGGGGSGGGGSGGGGSEIVLIQSPA

ILSLSPGERATLICSATSSVSYIHWYQQRPGQSPRLLIYSTSNLASGIPARFSGSGSGSDYILTISSLEPEDF

AVYYCQQRSSSPFTFGSGTKVEIK

Humanized E6 single chain IgGlnoC
(DNA)
(SEQ ID NO: 234)
gaggtgcagctggtggagtctggggagggcctggtcaagcctggggggtccctgagactctcctgtgcagcct ctggattcaccttcagtaggtatggcatgagctgggtccgccaggctccagggaagaggctggagtgggtctc aaccattagtggcggaggcacctacatatactacccagactcagtgaagggccgattcaccatctccagagac aacgccaagaacaccctgtatctgcaaatgaacagcctgagagccgaggacacggctgtgtattactgtacca gagataactatggccgcaactatgattatggcatggattattggggccagggcaccctggtgaccgtgagcag cgataaaacccatactaaaccgccaaaaccggcgccggaactgctgggtggtcctggtaccggtgaaattgtg ttgacacagtctccagccaccctgtctttgtctccaggggaaagagccaccctcacctgcagcgccaccagca gtgttagctacatccactggtaccaacagaggcctggccagagccccaggctcctcatctatagcacctccaa cctggccagcggcatcccagccaggttcagtggcagtgggtctgggagcgactacactctcaccatcagcagc ctagagcctgaagattttgcagtttattactgtcagcagcgtagcagctccccttttacctttggcagcggca ccaaagtggaaattaaa (amino acids)
(SEQ ID NO: 235)
EVQLVESGGGLVKPGGSLRLSCAASGFTFSRYGMSWVRQAPGKRLEWVSTISGGGTYIYYPDSVKGRFTISRD

NAKNTLYLQMNSLRAEDTAVYYCTRDNYGRNYDYGMDYWGQGTLVTVSSDKTHTKPPKPAPELLGGPGTGEIV

LTQSPATLSLSPGERATLTCSATSSVSYIHWYQQRPGQSPRLLIYSTSNLASGIPARFSGSGSGSDYTLTISS

LEPEDFAVYYCQQRSSSPFTFGSGTKVEIK

Humanized E6 single chain X4 (linker is IgG1 and IgG2 modified hinge region)
(DNA)

(SEQ ID NO: 236)

gaggtgcagctggtggagtctgggggaggcctggtcaagcctggggggtccctgagactctcctgtgcagcct ctggattcaccttcagtaggtatggcatgagctgggtccgccaggctccagggaagaggctggagtgggtctc aaccattagtggcggaggcacctacatatactacccagactcagtgaagggccgattcaccatctccagagac aacgccaagaacaccctgtatctgcaaatgaacagcctgagagccgaggacacggctgtgtattactgtacca gagataactatggccgcaactatgattatggcatggattattggggccagggcaccctggtgaccgtgagcag cgataaaacccatactaaaccgccaaaaccggcgccggaactgctggttggtcctggtaccggtactggtggt ccgactattaaacctccgaaacctccgaaacctgctccgaacctgctgggtggtccggaaattgtgttgacac agtctccagccaccctgtctttgtctccaggggaaagagccaccctcacctgcagcgccaccagcagtgttag ctacatccactggtaccaacagaggcctggccagagccccaggctcctcatctatagcacctccaacctggcc agcggcatcccagccaggttcagtggcagtgggtctgggagcgactacactctcaccatcagcagcctagagc ctgaagattttgcagtttattactgtcagcagcgtagcagctcccctttcacctttggcagcggcaccaaagt ggaaattaaa (amino acids)

(SEQ ID NO: 237)

EVQLVESGGGLVKPGGSLRLSCAASGFTFSRYGMSWVRQAPGKRLEWVSTISGGGTYIYYPDSVKGRFTISRD

NAKNTLYLQMNSLRAEDTAVYYCTRDNYGRNYDYGMDYWGQGTLVTVSSDKTHTKPPKPAPELLGGPGTGTGC

PTIKPPKPPKPAPNLLGGPEIVLTQSPATLSLSPGERATLTCSATSSVSYIHWYQQRPGQSPRLLIYSTSNLA

SGIPARFSGSGSGSDYTLTISSLEPEDFAVYYCQQRSSSPFTFGSGTKVEIK

Humanized C2 single chain GS3
(DNA)

(SEQ ID NO: 238)

gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccccgactcagtgaagggccgattcaccatctccagagac aacgccaagaactcactgtatctgcaaatgaacagcctgagagccgaggacacggccgtgtattactgtgcga gacttgggggggataattactacgaatacttcgatgtctggggcaaagggaccacggtcaccgtctcctccgg cggtggcggatccggcggtggcggatccggcggtggcggatccgacattgtgctgacccagtctccagcctcc ttggccgtgtctccaggacagagggccaccatcacctgcagagccagtaagagtgtcagtaccagcggatact cctacatgcactggtatcagcagaaaccaggacaacctcctaaactcctgatttacctggcatccaatctgga gagcggggtcccagccaggttcagcggcagtgggtctgggaccgatttcaccctcacaattaatcctgtggaa gctaatgatactgcaaattattactgtcagcacagtagggagctgcctttcacattcggcggagggaccaagg tggagatcaaacgaact (amino acids)

(SEQ ID NO: 239)

EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYFDVWGKGTTVTVSSGGGGSGGGGSGGGGSDIVLTQSPAS

LAVSPGQRATITCRASKSVSTSGYSYMHWYQQKPGQPPKLLIYLASNLESGVPARFSGSGSGTDFTLTINPVE

ANDTANYYCQHSRELPFTFGGGTKVEIKRT

Humanized C2 single chain IgG (no Cysteine)
(DNA)

(SEQ ID NO: 240)

gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc -continued

```
aaccattagtagtggcggaacctacatatactaccccgactcagtgaagggccgattcaccatctccagagac aacgccaagaactcactgtatctgcaaatgaacagcctgagagccgaggacacggccgtgtattactgtgcga gacttggggggataattactacgaatacttcgatgtctggggcaaagggaccacggtcaccgtctcctccga taaaacccatactaaaccgccaaaaccggcgccggaactgctgggtggtcctggtaccggtgacattgtgctg acccagtctccagcctccttggccgtgtctccaggacagagggccaccatcacctgcagagccagtaagagtg tcagtaccagcggatactcctacatgcactggtatcagcagaaaccaggacaacctcctaaactcctgattta cctggcatccaatctggagagcggggtcccagccaggttcagcggcagtgggtctgggaccgatttcacccttc acaattaatcctgtggaagctaatgatactgcaaattattactgtcagcacagtagggagctgccttttcacat tcggcggagggaccaaggtggagatcaaacgaact
```

(amino acids)

(SEQ ID NO: 241)

```
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYFDVWGKGTTVTVSSDKTHTKPPKPAPELLGGPGTGDIVL

TQSPASLAVSPGQRATITCRASKSVSTSGYSYMHWYQQKPGQPPKLLIYLASNLESGVPARFSGSGSGTDFTL

TINPVEANDTANYYCQHSRELPFTFGGGTKVEIKRT
```

Humanized C2 single chain X4 (linker is IgG1 and IgG2 modified hinge region)
(DNA)

(SEQ ID NO: 242)

```
gaggtgcagctggtggagtctggggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccccgactcagtgaagggccgattcaccatctccagagac aacgccaagaactcactgtatctgcaaatgaacagcctgagagccgaggacacggccgtgtattactgtgcga gacttggggggataattactacgaatacttcgatgtctggggcaaagggaccacggtcaccgtctcctccga taaaacccatactaaaccgccaaaaccggcgccggaactgctgggtggtcctggtactggtggtccg actattaaacctccgaaacctccgaaacctgctccgaacctgctgggtggtccggacattgtgctgacccagt ctccagcctccttggccgtgtctccaggacagagggccaccatcacctgcagagccagtaagagtgtcagtac cagcggatactcctacatgcactggtatcagcagaaaccaggacaacctcctaaactcctgatttacctggca tccaatctggagagcggggtcccagccaggttcagcggcagtgggtctgggaccgatttcacccttcacaatta atcctgtggaagctaatgatactgcaaattattactgtcagcacagtagggagctgccttttcacattcggcgg agggaccaaggtggagatcaaacgaact
```

(amino acids)

(SEQ ID NO: 243)

```
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYFDVWGKGTTVTVSSDKTHTKPPKPAPELLGGPGTGTGGP

TIKPPKPPKPAPNLLGGPDIVLTQSPASLAVSPGQRATITCRASKSVSTSGYSYMHWYQQKPGQPPKLLIYLA

SNLESGVPARFSGSGSGTDFTLTINPVEANDTANYYCQHSRELPFTFGGGTKVEIKRT
```

Humanized C3 single chain GS3
(DNA)

(SEQ ID NO: 244)

```
caggttcagctggtgcagtctggagctgaggtgaagaagcctggggcctcagtgaaggtctcctgcaaggctt ctggttacacctttaccgactacgccatgaactgggtgcgacaggcccctggacaagggcttgagtggatggg agtgatcagcacctcagcggtaacacaaacttcaaccagaagttcaagggcagagtcaccatgaccacagac acatccacgagcacagcctacatggagctgaggagcctgagatctgacgacacggccgtgtattactgtgcga gaagcgactactacggcccatacttcgactactggggccagggcaccaccctgaccgtgtccagcggcggtgg cggatccggcggtggcggatccggcggtggcggatccgatattgtgatgacccagactccactctctctgtcc
```

-continued gtcaccctggacagccggcctccatctcctgcaggtctagtcagaccattgtccatagtaatggaaacacct atttggagtggtacctgcagaagccaggccagtctccacagctcctgatctataaggtttccaaccggttctc tggagtgccagataggttcagtggcagcgggtcagggacagatttcacactgaaaatcagccgggtggaggct gaggatgttggggtttattactgcttccaaggtagccacgtgcctttcaccttcggcggagggaccaaggtgg agatcaaacgaact (amino acids)

(SEQ ID NO: 245)
QVQLVQSGAEVKKPGASVKVSCKASGYTFTDYAMNWVRQAPGQGLEWMGVISTFSGNTNFNQKFKGRVTMTTD

TSTSTAYMELRSLRSDDTAVYYCARSDYYGPYFDYWGQGTTLTVSSGGGGSGGGGSGGGGSDIVMTQTPLSLS

VTPGQPASISCRSSQTIVHSNGNTYLEWYLQKPGQSPQLLIYKVSNRFSGVPDRFSGSGSGTDFTLKISRVEA

EDVGVYYCFQGSHVPFTFGGGTKVEIKRT

Humanized C3 single chain IgG1 (no Cysteine)
(DNA)

(SEQ ID NO: 246)
caggttcagctggtgcagtctggagctgaggtgaagaagcctggggcctcagtgaaggtctcctgcaaggctt ctggttacacctttaccgactacgccatgaactgggcgacaggcccctggacaagggcttgagtggatggg agtgatcagcaccttcagcggtaacacaaacttcaaccagaagttcaagggcagagtcaccatgaccacagac acatccacgagcacagcctacatggagctgaggagcctgagatctgacgacacggccgtgtattactgtgcga gaagcgactactacggcccatacttcgactactggggccagggcaccaccctgaccgtgtccagcgataaaac ccatactaaaccgccaaaaccggcgccggaactgctgggtggtcctggtaccggtgatattgtgatgacccag actccactctctctgtccgtcacccctggacagccggcctccatctcctgcaggtctagtcagaccattgtcc atagtaatggaaacacctatttggagtggtacctgcagaagccaggccagtctccacagctcctgatctataa ggtttccaaccggttctctggagtgccagataggttcagtggcagcgggtcagggacagatttcacactgaaa atcagccgggtggaggctgaggatgttggggtttattactgcttccaaggtagccacgtgcctttcaccttcg gcggagggaccaaggtggagatcaaacgaact (amino acids)

(SEQ ID NO: 247)
QVQLVQSGAEVKKPGASVKVSCKASGYTFTDYAMNWVRQAPGQGLEWMGVISTFSGNTNFNQKFKGRVTMTTD

TSTSTAYMELRSLRSDDTAVYYCARSDYYGPYFDYWGQGTTLTVSSDKTHTKPPKPAPELLGGPGTGDIVMTQ

TPLSLSVTPGQPASISCRSSQTIVHSNGNTYLEWYLQKPGQSPQLLIYKVSNRFSGVPDRFSGSGSGTDFTLK

ISRVEAEDVGVYYCFQGSHVPFTFGGGTKVEIKRT

Humanized C3 single chain X4 (linker is IgG1 and IgG2 modified hinge
region)
(DNA)

(SEQ ID NO: 248)
caggttcagctggtgcagtctggagctgaggtgaagaagcctggggcctcagtgaaggtctcctgcaaggctt ctggttacacctttaccgactacgccatgaactgggcgacaggcccctggacaagggcttgagtggatggg agtgatcagcaccttcagcggtaacacaaacttcaaccagaagttcaagggcagagtcaccatgaccacagac acatccacgagcacagcctacatggagctgaggagcctgagatctgacgacacggccgtgtattactgtgcga gaagcgactactacggcccatacttcgactactggggccagggcaccaccctgaccgtgtccagcgataaaac ccatactaaaccgccaaaaccggcgccggaactgctgggtggtcctggtaccggtactggtggtccgactatt aaacctccgaaacctccgaaacctgctccgaacctgctgggtggtccggatattgtgatgacccagactccac tctctctgtccgtcacccctggacagccggcctccatctcctgcaggtctagtcagaccattgtccatagtaa tggaaacacctatttggagtggtacctgcagaagccaggccagtctccacagctcctgatctataaggtttcc

```
aaccggttctctggagtgccagataggttcagtggcagcgggtcagggacagatttcacactgaaaatcagcc gggtggaggctgaggatgttggggtttattactgcttccaaggtagccacgtgcctttcaccttcggcggagg gaccaaggtggagatcaaacgaact
```

(amino acids)

(SEQ ID NO: 249)
```
QVQLVQSGAEVKKPGASVKVSCKASGYTFTDYAMNWVRQAPGQGLEWMGVISTFSGNTNFNQKFKGRVTMTTD

TSTSTAYMELRSLRSDDTAVYYCARSDYYGPYFDYWGQGTTLTVSSDKTHTKPPKPAPELLGGPGTGTGGPTI

KPPKPPKPAPNLLGGPDIVMTQTPLSLSVTPGQPASISCRSSQTIVHSNGNTYLEWYLQKPGQSPQLLIYKVS

NRFSGVPDRFSGSGSGTDFTLKISRVEAEDVGVYYCFQGSHVPFTFGGGTKVEIKRT
```

Humanized C8 single chain GS3 (linker is +Gly4Ser1+3)
(DNA)

(SEQ ID NO: 250)
```
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccctgactcagtgaagggccgattcaccatctccagagac aacgccaagaactcactgtatctgcaaatgaacagcctgagagccgaggacacggccgtgtattactgtgcga gactgggcggcgataactattatgaatattggggcaaagggaccacggtcaccgtctcctccggcggtggcgg atccggcggtggcggatccggcggtggcggatccgacatcgtgatgacccagtctccagactccctggctgtg tctctgggcgagagggccaccatcaactgcagggccagcaagagtgttagcaccagcggctacagctacatgc actggtaccagcagaaaccaggacagcctcctaagctgctcatttacctggtgtctaacctggaatccgggt ccctgaccgattcagtggcagcgggtctgggacagatttcactctcaccatcagcagcctgcaggctgaagat gtggcagtttattactgtcaacacattcgggaactgaccaggagtgaattcggcggagggaccaaggtggaga tcaaacgaact
```

(amino acids)

(SEQ ID NO: 251)
```
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYWGKGTTVTVSSGGGGSGGGGSGGGGSDIVMTQSPDSLAV

SLGERATINCRASKSVSTSGYSYMHWYQQKPGQPPKLLIYLVSNLESGVPDRFSGSGSGTDFTLTISSLQAED

VAVYYCQHIRELTRSEFGGGTKVEIKRT
```

Humanized C8 single chain IgG1 (no Cysteine)
(DNA)

(SEQ ID NO: 252)
```
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccctgactcagtgaagggccgattcaccatctccagagac aacgccaagaactcactgtatctgcaaatgaacagcctgagagccgaggacacggccgtgtattactgtgcga gactgggcggcgataactattatgaatattggggcaaagggaccacggtcaccgtctcctccgataaaaccca tactaaaccgccaaaaccggcgccggaactgctgggtggtcctggtaccggtgacatcgtgatgacccagtct ccagactccctggctgtgtctctgggcgagagggccaccatcaactgcagggccagcaagagtgttagcacca gcggctacagctacatgcactggtaccagcagaaaccaggacagcctcctaagctgctcatttacctggtgtc taacctggaatccggggtccctgaccgattcagtggcagcgggtctgggacagatttcactctcaccatcagc agcctgcaggctgaagatgtggcagtttattactgtcaacacattcgggaactgaccaggagtgaattcggcg gagggaccaaggtggagatcaaacgaact
```

(amino acids)

(SEQ ID NO: 253)
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYWGKGTTVTVSSDKTHTKPPKPAPELLGGPGTGDIVMTQS

PDSLAVSLGERATINCRASKSVSTSGYSYMHWYQQKPGQPPKLLIYLVSNLESGVPDRFSGSGSGTDFTLTIS

SLQAEDVAVYYCQHIRELTRSEFGGGTKVEIKRT

Humanized C8 single chain X4 (linker is IgG1 and IgG2 modified hinge
region)
(DNA)

(SEQ ID NO: 254)
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactacccagactcagtgaagggccgattcaccatctccagagac aacgccaagaactcactgtatctgcaaatgaacagcctgagagccgaggacacggccgtgtattactgtgcga gactgggcggcgacaattactatgagtattggggcaaagggaccacggtcaccgtctcctccgataaaaccca tactaaaccgccaaaaccggcgccggaactgctgggtggtcctggtaccggtactggtggtccgactattaaa cctccgaaacctccgaaacctgctccgaacctgctgggtggtccggacatcgtgatgacccagtctccagact ccctggctgtgtctctgggcgagagggccaccatcaactgcagggccagcaagagtgttagcaccagcggcta cagctacatgcactggtaccagcagaaaccaggacagcctcctaagctgctcatttacctggtgtctaacctg gaatccggggtccctgaccgattcagtggcagcgggtctgggacagatttcactctcaccatcagcagcctgc aggctgaagatgtggcagtttattactgtcaacacattcgggaactgaccaggagtgaattcggcggagggac caaggtggagatcaaacgaact (amino acids)

(SEQ ID NO: 255)
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYWGKGTTVTVSSDKTHTKPPKPAPELLGGPGTGTGGPTIK

PPKPPKPAPNLLGGPDIVMTQSPDSLAVSLGERATINCRASKSVSTSGYSYMHWYQQKPGQPPKLLIYLVSNL

ESGVPDRFSGSGSGTDFTLTISSLQAEDVAVYYCQHIRELTRSEFGGGTKVEIKRT pSECTag2 E6 scFV-FC
(DNA)

(SEQ ID NO: 256)
atggagacagacacactcctgctatgggtactgctgctctgggttccaggttccactggtgacgcgg cccagccggccgaggtgcagctggtggagtctgggggaggcctggtcaagcctggggggtccctgag actctcctgtgcagcctctggattcaccttcagtaggtatggcatgagctgggtccgccaggctcca gggaagaggctggagtgggtctcaaccattagtggcggaggcacctacatatactacccagactcag tgaagggccgattcaccatctccagagacaacgccaagaacaccctgtatctgcaaatgaacagcct gagagccgaggacacggctgtgtattactgtaccagagataactatggccgcaactatgattatggc atggattattggggccagggcaccctggtgaccgtgagcagcggcggtggcggatcggcggtggcg gatccggcggtggcggatccgaaattgtgttgacacagtctccagccaccctgtctttgtctccagg ggaaagagccaccctcacctgcagcgccaccagcagtgttagctacatccactggtaccaacagagg cctggccagagcccaggctcctcatctatagcacctccaacctggccagcggcatcccagccaggt tcagtggcagtgggtctgggagcgactacactctcaccatcagcagcctagagcctgaagattttgc agtttattactgtcagcagcgtagcagctccccttttacctttggcagcggcaccaaagtggaaatt aaagagcccaaatcttgtgacaaaactcacacatgcccaccgtgcccagcacctgaactcctggggg gaccgtcagtcttcctcttccccccaaaacccaaggacaccctcatgatctcccggacccctgaggt cacatgcgtggtggtggacgtgagccacgaagaccctgaggtcaagttcaactggtacgtggacggc -continued gtggaggtgcataatgccaagacaaagccgcgggaggagcagtacaacagcacgtaccgtgtggtca gcgtcctcaccgtcctgcaccaggactggctgaatggcaaggagtacaagtgcaaggtctccaacaa agccctcccagcccccatcgagaaaaccatctccaaagccaaggggcagccccgagaaccacaggtg tacaccctgcccccatcccgggaggagatgaccaagaaccaggtcagcctgacctgcctggtcaaag gcttctatcccagcgacatcgccgtggagtgggagagcaatgggcagccggagaacaactacaagac cacgcctcccgtgctggactccgacggctccttcttcctctacagcaagctcaccgtggacaagagc aggtggcagcaggggaacgtcttctcatgctccgtgatgcatgaggctctgcacaaccactacacgc agaagagcctctccctgtctccgggtaaatgataa (amino acids)
(SEQ ID NO: 257)
METDTLLLWVLLLWVPGSTGDAAQPAEVQLVESGGGLVKPGGSLRLSCAASGFTFSRYGMSWVRQAP

GKRLEWVSTISGGGTYIYYPDSVKGRFTISRDNAKNTLYLQMNSLRAEDTAVYYCTRDNYGRNYDYG

MDYWGQGTLVTVSSGGGGSGGGGSGGGGSEIVLTQSPATLSLSPGERATLTCSATSSVSYIHWYQQR

PGQSPRLLIYSTSNLASGIPARFSGSGSGSDYTLTISSLEPEDFAVYYCQQRSSSPFTFGSGTKVEI

KEPKSCDKTHTCPPCPAPELLGGPSVFLFPPKPKDTLMISRTPEVTCVVVDVSHEDPEVKFNWYVDG

VEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGK**

E6 scFC-FC 1 gBLOCk sequence:
(SEQ ID NO: 258)
tgctctgggttccaggttccactggtgacgcggcccagccggccgaggtgcagctggtggagtctgg gggaggcctggtcaagcctggggggtccctgagactctcctgtgcagcctctggattcaccttcagt aggtatggcatgagctgggtccgccaggctccagggaagaggctggagtgggtctcaaccattagtg gcggaggcacctacatatactacccagactcagtgaagggccgattcaccatctccagagacaacgc caagaacaccctgtatctgcaaatgaacagcctgagagccgaggacacggctgtgtattactgtacc agagataactatggccgcaactatgattatggcatggattattggggccagggcaccctggtgaccg tgagcagcggcggtggcggatccggcggtggcggatccggcggtggcggatccgaaattgtgttgac acagtctccagccaccctgtctttgtc E6 scFC-FC 2 gBLOCk sequence:
(SEQ ID NO: 259)
aattgtgttgacacagtctccagccaccctgtctttgtctccaggggaaagagccaccctcacctgc agcgccaccagcagtgttagctacatccactggtaccaacagagagcctggccagagcccaggctcc tcatctatagcacctccaacctggccagcggcatcccagccaggttcagtggcagtgggtctgggag cgactacactctcaccatcagcagcctagagcctgaagattttgcagtttattactgtcagcagcgt agcagctcccctttcacctttggcagcggcaccaaagtggaaattaaagagcccaaatcttgtgaca aaactcacacatgcccaccgtgcccagcacctgaactcctggggggaccgtcagtcttcctcttccc cccaaaacccaaggacaccctcatgatctcccggacccctgaggtcacatgcgtggtggtggacgtg agccacgaagaccctgaggtcaagttcaactggtacgtggacggcgtggaggtgcataatgccaaga caaagccgcgggaggagcagtacaacagcacgtaccgtgtggtcagc pSECTag2 C2 scFV-FC
(DNA)
(SEQ ID NO: 260)
atggagacagacacactcctgctatgggtactgctgctctgggttccaggttccactggtgacgcgg cccagccggccgaggtgcagctggtggagtctggggggaggcctggtcaagcctggggggtccctgag actctcctgtgcagcctctggattcaccttcagtggctatgccatgagctgggtccgccaggctcca -continued

```
gggaaggggctggagtgggtctcaaccattagtagtggcggaacctacatatactaccccgactcag tgaagggccgattcaccatctccagagacaacgccaagaactcactgtatctgcaaatgaacagcct gagagccgaggacacggccgtgtattactgtgcgagacttgggggggataattactacgaatacttc gatgtctggggcaaagggaccacggtcaccgtctcctccggcggtggcggatccggcggtggcggat ccggcggtggcggatccgacattgtgctgacccagtctccagcctccttggccgtgtctccaggaca gagggccaccatcacctgcagagccagtaagagtgtcagtaccagcggatactcctacatgcactgg tatcagcagaaaccaggacaacctcctaaactcctgatttacctggcatccaatctggagagcgggg tcccagccaggttcagcggcagtgggtctgggaccgatttcaccctcacaattaatcctgtggaagc taatgatactgcaaattattactgtcagcacagtagggagctgcctttcacattcggcggagggacc aaggtggagatcaaacgaactgagcccaaatcttgtgacaaaactcacacatgcccaccgtgcccag cacctgaactcctgggggggaccgtcagtcttcctcttccccccaaaacccaaggacaccctcatgat ctcccggacccctgaggtcacatgcgtggtggtggacgtgagccacgaagaccctgaggtcaagttc aactggtacgtggacggcgtggaggtgcataatgccaagacaaagccgcgggaggagcagtacaaca gcacgtaccgtgtggtcagcgtcctcaccgtcctgcaccaggactggctgaatggcaaggagtacaa gtgcaaggtctccaacaaagccctcccagcccccatcgagaaaaccatctccaaagccaaagggcag ccccgagaaccacaggtgtacaccctgcccccatcccgggaggagatgaccaagaaccaggtcagcc tgacctgcctggtcaaaggcttctatcccagcgacatcgccgtggagtgggagagcaatgggcagcc ggagaacaactacaagaccacgcctcccgtgctggactccgacggctccttcttcctctacagcaag ctcaccgtggacaagagcaggtggcagcaggggaacgtcttctcatgctccgtgatgcatgaggctc tgcacaaccactacacgcagaagagcctctccctgtctccgggtaaatgataa
```

(amino acids)
(SEQ ID NO: 261)
```
METDTLLLWVLLLWVPGSTGDAAQPAEVQLVESGGGLVKPGGSLRLSCAASGFTFSGYAMSWVRQAP

GKGLEWVSTISSGGTYIYYPDSVKGRFTISRDNAKNSLYLQMNSLRAEDTAVYYCARLGGDNYYEYF

DVWGKGTTVTVSSGGGGSGGGGSGGGGSDIVLTQSPASLAVSPGQRATITCRASKSVSTSGYSYMHW

YQQKPGQPPKLLIYLASNLESGVPARFSGSGSGTDFTLTINPVEANDTANYYCQHSRELPFTFGGGT

KVEIKRTEPKSCDKTHTCPPCPAPELLGGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSK

LTVDKSRWQQGNVESCSVMHEALHNHYTQKSLSLSPGK**
```

C2 scFV-FC 1 gBLOCk sequence:
(DNA)
(SEQ ID NO: 262)
```
tgctctgggttccaggttccactggtgacgcggcccagccggccgaggtgcagctggtggagtctgg gggaggcctggtcaagcctggggggtccctgagactctcctgtgcagcctctggattcaccttcagt ggctatgccatgagctgggtccgccaggctccagggaaggggctggagtgggtctcaaccattagta gtggcggaacctacatatactaccccgactcagtgaagggccgattcaccatctccagagacaacgc caagaactcactgtatctgcaaatgaacagcctgagagccgaggacacggccgtgtattactgtgcg agacttgggggggataattactacgaatacttcgatgtctggggcaaagggaccacggtcaccgtct cctccggcggtggcggatccggcggtggcggatccggcggtggcggatccgacattgtgctgaccca gtctccagcctccttggc
```

C2 scFV-FC 2 gBLOCk sequence:
(DNA)

(SEQ ID NO: 263)

cattgtgctgacccagtctccagcctccttggccgtgtctccaggacagagggccaccatcacctgc agagccagtaagagtgtcagtaccagcggatactcctacatgcactggtatcagcagaaaccaggac aacctcctaaactcctgatttacctggcatccaatctggagagcggggtcccagccaggttcagcgg cagtgggtctgggaccgatttcaccctcacaattaatcctgtggaagctaatgatactgcaaattat tactgtcagcacagtagggagctgcctttcacattcggcggagggaccaaggtggagatcaaacgaa ctgagcccaaatcttgtgacaaaactcacacatgcccaccgtgcccagcacctgaactcctgggggg accgtcagtcttcctcttccccccaaaacccaaggacaccctcatgatctcccggacccctgaggtc acatgcgtggtggtggacgtgagccacgaagaccctgaggtcaagttcaactggtacgtggacggcg tggaggtgcataatgccaagacaaagccgcgggaggagcagtacaacagcacgtaccgtgtggtcag c pSECTag2 C3 scFV-FC
(DNA)

(SEQ ID NO: 264)

atggagacagacacactcctgctatgggtactgctgctctgggttccaggttccactggtgacgcgg cccagccggcccaggttcagctggtgcagtctggagctgaggtgaagaagcctggggcctcagtgaa ggtctcctgcaaggcttctggttacacctttaccgactacgccatgaactgggtgcgacaggcccct ggacaagggcttgagtggatgggagtgatcagcaccttcagcggtaacacaaacttcaaccagaagt tcaagggcagagtcaccatgaccacagacacatccacgagcacagcctacatggagctgaggagcct gagatctgacgacacggccgtgtattactgtgcgagaagcgactactacggcccatacttcgactac tggggccagggcaccaccctgaccgtgtccagcggcggtggcggatccggcggtggcggatccggcg gtggcggatccgatattgtgatgacccagactccactctctctgtccgtcacccctggacagccggc ctccatctcctgcaggtctagtcagaccattgtccatagtaatggaaacaccctatttggagtggtac ctgcagaagccaggccagtctccacagctcctgatctataaggtttccaaccggttctctggagtgc cagataggttcagtggcagcgggtcagggacagatttcacactgaaaatcagccgggtggaggctga ggatgttggggtttattactgcttccaaggtagccacgtgcctttcaccttcggcggagggaccaag gtggagatcaaacgaactgagcccaaatcttgtgacaaaactcacacatgcccaccgtgcccagcac ctgaactcctggggggaccgtcagtcttcctcttccccccaaaacccaaggacaccctcatgatctc ccggacccctgaggtcacatgcgtggtggtggacgtgagccacgaagaccctgaggtcaagttcaac tggtacgtggacggcgtggaggtgcataatgccaagacaaagccgcgggaggagcagtacaacagca cgtaccgtgtggtcagcgtcctcaccgtcctgcaccaggactggctgaatggcaaggagtacaagtg caaggtctccaacaaagccctcccagcccccatcgagaaaaccatctccaaagccaaagggcagccc cgagaaccacaggtgtacaccctgcccccatcccgggaggagatgaccaagaaccaggtcagcctga cctgcctggtcaaaggcttctatcccagcgacatcgccgtggagtgggagagcaatgggcagccgga gaacaactacaagaccacgcctcccgtgctggactccgacggctccttcttcctctacagcaagctc accgtggacaagagcaggtggcagcaggggaacgtcttctcatgctccgtgatgcatgaggctctgc acaaccactacacgcagaagagcctctccctgtctccgggtaaatgataa (amino acids)

(SEQ ID NO: 265)

METDTLLLWVLLLWVPGSTGDAAQPAQVQLVQSGAEVKKPGASVKVSCKASGYTFTDYAMNWVRQAPGQGLEW

MGVISTFSGNTNFNQKFKGRVTMTTDTSTSTAYMELRSLRSDDTAVYYCARSDYYGPYFDYWGQGTTLTVSSG

GGGSGGGGSGGGGSDIVMTQTPLSLSVTPGQPASISCRSSQTIVHSNGNTYLEWYLQKPGQSPQLLIYKVSNR

FSGVPDRFSGSGSGTDFTLKISRVEAEDVGVYYCFQGSHVPFTFGGGTKVEIKRTEPKSCDKTHTCPPCPAPE

LLGGPSVFLFPPKPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCLVKGFYPSDIAV

EWESNGQPENNYKTTPPVLDSDGSFFLYSKLTVDKSRWQQGNVFSCSVMHEALHNHYTQKSLSLSPGK**

C3 GS scFV FC 1 gBLOCk sequence:
(DNA)

(SEQ ID NO: 266)

tgctctgggttccaggttccactggtgacgcggcccagccggcccaggttcagctggtgcagtctgg agctgaggtgaagaagcctggggcctcagtgaaggtctcctgcaaggcttctggttacacctttacc gactacgccatgaactgggtgcgacaggcccctggacaagggcttgagtggatgggagtgatcagca ccttcagcggtaacacaaacttcaaccagaagttcaagggcagagtcaccatgaccacagacacatc cacgagcacagcctacatggagctgaggagcctgagatctgacgacacggccgtgtattactgtgcg agaagcgactactacggcccatacttcgactactggggccagggcaccaccctgaccgtgtccagcg gcggtggcggatccggcggtggcggatccggcggtggcggatccgatattgtgatgacccagactcc actctctctgt C3 scFV FC2 gBLOCk sequence:
(DNA)

(SEQ ID NO: 267)

tattgtgatgacccagactccactctctctgtccgtcacccctggacagccggcctccatctcctgc aggtctagtcagaccattgtccatagtaatggaaacacctatttggagtggtacctgcagaagccag gccagtctccacagctcctgatctataaggtttccaaccggttctctggagtgccagataggttcag tggcagcgggtcagggacagatttcacactgaaaatcagccgggtggaggctgaggatgttgggggtt tattactgcttccaaggtagccacgtgcctttcaccttcggcggagggaccaaggtggagatcaaac gaactgagcccaaatcttgtgacaaaactcacacatgcccaccgtgcccagcacctgaactcctggg gggaccgtcagtcttcctcttccccccaaaacccaaggacaccctcatgatctcccggacccctgag gtcacatgcgtggtggtggacgtgagccacgaagaccctgaggtcaagttcaactggtacgtggacg gcgtggaggtgcataatgccaagacaaagccgcgggaggagcagtacaacagcacgtaccgtgtggt cagc pSECTag2 C8 scFV-FC
(DNA)

(SEQ ID NO: 268)

atggagacagacacactcctgctatgggtactgctgctctgggttccaggttccactggtgacgcgg cccagccggccgaggtgcagctggtggagtctggggggaggcctggtcaagcctggggggtccctgag actctcctgtgcagcctctggattcaccttcagtggctatgccatgagctgggtccgccaggctcca gggaaggggctggagtgggtctcaaccattagtagtggcggaacctacatatactaccctgactcag tgaagggccgattcaccatctccagagacaacgccaagaactcactgtatctgcaaatgaacagcct gagagccgaggacacggccgtgtattactgtgcgagactggcggcgataactattatgaatattgg ggcaaagggaccacggtcaccgtctcctccggcggtggcggatccggcggtggcggatccgcggtg gcggatccgacatcgtgatgacccagtctccagactccctggctgtgtctctgggcgagagggccac catcaactgcagggccagcaagagtgttagcaccagcggctacagctacatgcactggtaccagcag aaaccaggacagcctcctaagctgctcatttacctggtgtctaacctggaatccggggtccctgacc gattcagtggcagcgggtctgggacagatttcactctcaccatcagcagcctgcaggctgaagatgt ggcagtttattactgtcaacacattcgggaactgaccaggagtgaattcggcggagggaccaaggtg gagatcaaacgaactgagcccaaatcttgtgacaaaactcacacatgcccaccgtgcccagcacctg aactcctgggggaccgtcagtcttcctcttccccccaaaacccaaggacaccctcatgatctcccg -continued gaccoctgaggtcacatgcgtggtggtggacgtgagccacgaagaccctgaggtcaagttcaactgg tacgtggacggcgtggaggtgcataatgccaagacaaagccgcgggaggagcagtacaacagcacgt accgtgtggtcagcgtcctcaccgtcctgcaccaggactggctgaatggcaaggagtacaagtgcaa ggtctccaacaaagccctcccagcccccatcgagaaaaccatctccaaagccaaagggcagccccga gaaccacaggtgtacaccctgcccccatcccgggaggagatgaccaagaaccaggtcagcctgacct gcctggtcaaaggcttctatcccagcgacatcgccgtggagtgggagagcaatgggcagccggagaa caactacaagaccacgcctcccgtgctggactccgacggctccttcttcctctacagcaagctcacc gtggacaagagcaggtggcagcaggggaacgtcttctcatgctccgtgatgcatgaggctctgcaca accactacacgcagaagagcctctccctgtctccgggtaaatgataa (amino acids)

(SEQ ID NO: 269)

METDTLLLWVLLLWVPGSTGDAAQPAEVQLVESGGGLVKPGGSLRLSCAASGFTFSGYAMSWVRQAPGKGLEW

VSTISSGGTYIYYPDSVKGRFTISRDNAKNSLYLQMNSLRAEDTAVYYCARLGGDNYYEYWGKGTTVTVSSGG

GGSGGGGSGGGGSDIVMTQSPDSLAVSLGERATINCRASKSVSTSGYSYMHWYQQKPGQPPKLLIYLVSNLES

GVPDRFSGSGSGTDFTLTISSLQAEDVAVYYCQHIRELTRSEFGGGTKVEIKRTEPKSCDKTHTCPPCPAPEL

LGGPSVFLFPPKPKDTLMISRTPEVTCVVVDVSHEDPEVKFNWYVDGVEVHNAKTKPREEQYNSTYRVVSVLT

VLHQDWLNGKEYKCKVSNKALPAPIEKTISKAKGQPREPQVYTLPPSREEMTKNQVSLTCLVKGFYPSDIAVE

WESNGQPENNYKTTPPVLDSDGSFFLYSKLTVDKSRWQQGNVFSCSVMHEALHNHYTQKSLSLSPGK**

C8 scFV FC 1 gBLOCk sequence:
(DNA)

(SEQ ID NO: 270)

tgctctgggttccaggttccactggtgacgcggcccagccggccgaggtgcagctggtggagtctgg gggaggcctggtcaagcctggggggtccctgagactctcctgtgcagcctctggattcaccttcagt ggctatgccatgagctgggtccgccaggctccagggaaggggctggagtgggtctcaaccattagta gtggcggaacctacatatactaccctgactcagtgaagggccgattcaccatctccagagacaacgc caagaactcactgtatctgcaaatgaacagcctgagagccgaggacacggccgtgtattactgtgcg agactgggcggcgataactattatgaatattggggcaaagggaccacggtcaccgtctcctccggcg gtggcggatccggcggtggcggatccggcggtggcggatccgacatcgtgatgacccagtctccaga ctccctgg C8 scFV FC2 gBLOCk sequence:
(DNA)

(SEQ ID NO: 271)

catcgtgatgacccagtctccagactccctggctgtgtctctgggcgagagggccaccatcaactgc agggccagcaagagtgttagcaccagcggctacagctacatgcactggtaccagcagaaaccaggac agcctcctaagctgctcatttacctggtgtctaacctggaatccggggtccctgaccgattcagtgg cagcgggtctgggacagatttcactctcaccatcagcagcctgcaggctgaagatgtggcagtttat tactgtcaacacattcgggaactgaccaggagtgaattcggcggagggaccaaggtggagatcaaac gaactgagcccaaatcttgtgacaaaactcacacatgcccaccgtgcccagcacctgaactcctggg gggaccgtcagtcttcctcttccccccaaaacccaaggacaccctcatgatctcccggacccctgag gtcacatgcgtggtggtggacgtgagccacgaagaccctgaggtcaagttcaactggtacgtggacg gcgtggaggtgcataatgccaagacaaagccgcgggaggagcagtacaacagcacgtaccgtgtggt cagc -continued Human IgG1 Fc sequence:
(DNA)
(SEQ ID NO: 272)
gagcccaaatcttgtgacaaaactcacacatgcccaccgtgcccagcacctgaactcctggggggaccgtcag tcttcctcttccccccaaaacccaaggacaccctcatgatctcccggacccctgaggtcacatgcgtggtggt ggacgtgagccacgaagaccctgaggtcaagttcaactggtacgtggacggcgtggaggtgcataatgccaag acaaagccgcgggaggagcagtacaacagcacgtaccgtgtggtcagcgtcctcaccgtcctgcaccaggact ggctgaatggcaaggagtacaagtgcaaggtctccaacaaagccctcccagcccccatcgagaaaaccatctc caaagccaaagggcagccccgagaaccacaggtgtacaccctgcccccatcccgggaggagatgaccaagaac caggtcagcctgacctgcctggtcaaaggcttctatcccagcgacatcgccgtggagtgggagagcaatgggc agccggagaacaactacaagaccacgcctcccgtgctggactccgacggctccttcttcctctacagcaagct caccgtggacaagagcaggtggcagcaggggaacgtcttctcatgctccgtgatgcatgaggctctgcacaac cactacacgcagaagagcctctccctgtctccgggtaaatgataa (amino acids)
(SEQ ID NO: 273)
EPKSCDKTHTCPPCPAPELLGGPSVFLFPPKPKDTLMISRTPEVTCVVVDVSHEDPEVKFNWYVDGVEVHNAK

TKPREEQYNSTYRVVSVLTVLHQDWLNGKEYKCKVSNKALPAPIEKTISKAKGQPREPQVYTLPPSREEMTKN

QVSLTCLVKGFYPSDIAVEWESNGQPENNYKTTPPVLDSDGSFFLYSKLTVDKSRWQQGNVFSCSVMHEALHN

HYTQKSLSLSPGK**

Human IgG1 CH2-CH3 domain sequence:
(DNA)
(SEQ ID NO: 274)
ccgtgcccagcacctgaactcctggggggaccgtcagtcttcctcttccccccaaaacccaaggacaccctca tgatctcccggacccctgaggtcacatgcgtggtggtggacgtgagccacgaagaccctgaggtcaagttcaa ctggtacgtggacggcgtggaggtgcataatgccaagacaaagccgcgggaggagcagtacaacagcacgtac cgtgtggtcagcgtcctcaccgtcctgcaccaggactggctgaatggcaaggagtacaagtgcaaggtctcca acaaagccctcccagcccccatcgagaaaaccatctccaaagccaaagggcagccccgagaaccacaggtgta caccctgcccccatcccgggaggagatgaccaagaaccaggtcagcctgacctgcctggtcaaaggcttctat cccagcgacatcgccgtggagtgggagagcaatgggcagccggagaacaactacaagaccacgcctcccgtgc tggactccgacggctccttcttcctctacagcaagctcaccgtggacaagagcaggtggcagcaggggaacgt cttctcatgctccgtgatgcatgaggctctgcacaaccactacacgcagaagagcctctccctgtctccgggt aaatgataa (amino acids)
(SEQ ID NO: 275)
PCPAPELLGGPSVFLFPPKPKDTLMISRTPEVTCVVVDVSHEDPEVKFNWYVDGVEVHNAKTKPREEQYNSTY

RVVSVLTVLHQDWLNGKEYKCKVSNKALPAPIEKTISKAKGQPREPQVYTLPPSREEMTKNQVSLTCLVKGFY

PSDIAVEWESNGQPENNYKTTPPVLDSDGSFFLYSKLTVDKSRWQQGNVFSCSVMHEALHNHYTQKSLSLSPG

K**

Human IgG1 CH3 domain sequence:
(DNA)
(SEQ ID NO: 276)
gggcagccccgagaaccacaggtgtacaccctgcccccatcccgggaggagatgaccaagaaccaggtcagcc tgacctgcctggtcaaaggcttctatcccagcgacatcgccgtggagtgggagagcaatgggcagccggagaa caactacaagaccacgcctcccgtgctggactccgacggctccttcttcctctacagcaagctcaccgtggac aagagcaggtggcagcaggggaacgtcttctcatgctccgtgatgcatgaggctctgcacaaccactacacgc agaagagcctctccctgtctccgggtaaatgataa (amino acids)

(SEQ ID NO: 277)
GQPREPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK**

Human IgG1 Fc Y407R sequence:
(DNA)

(SEQ ID NO: 278)
gagcccaaatcttgtgacaaaactcacacatgcccaccgtgcccagcacctgaactcctggggggaccgtcag tcttcctcttccccccaaaacccaaggacaccctcatgatctcccggacccctgaggtcacatgcgtggtggt ggacgtgagccacgaagaccctgaggtcaagttcaactggtacgtggacggcgtggaggtgcataatgccaag acaaagccgcgggaggagcagtacaacagcacgtaccgtgtggtcagcgtcctcaccgtcctgcaccaggact ggctgaatggcaaggagtacaagtgcaaggtctccaacaaagccctcccagcccccatcgagaaaaccatctc caaagccaaagggcagccccgagaaccacaggtgtacaccctgcccccatcccgggaggagatgaccaagaac caggtcagcctgacctgcctggtcaaaggcttctatcccagcgacatcgccgtggagtgggagagcaatgggc agccggagaacaactacaagaccacgcctcccgtgctggactccgacggctccttcttcctcaggagcaagct caccgtggacaagagcaggtggcagcaggggaacgtcttctcatgctccgtgatgcatgaggctctgcacaac cactacacgcagaagagcctctccctgtctccgggtaaatgataa (amino acids)

(SEQ ID NO: 279)
EPKSCDKTHTCPPCPAPELLGGPSVFLFPPKPKDTLMISRTPEVTCVVVDVSHEDPEVKFNWYVDGVEVHNAK

TKPREEQYNSTYRVVSVLTVLHQDWLNGKEYKCKVSNKALPAPIEKTISKAKGQPREPQVYTLPPSREEMTKN

QVSLTCLVKGFYPSDIAVEWESNGQPENNYKTTPPVLDSDGSFFLRSKLTVDKSRWQQGNVFSCSVMHEALHN

HYTQKSLSLSPGK**

Human IgG1 Fc F405Q sequence:
(DNA)

(SEQ ID NO: 280)
gagcccaaatcttgtgacaaaactcacacatgcccaccgtgcccagcacctgaactcctggggggaccgtcag tcttcctcttccccccaaaacccaaggacaccctcatgatctcccggacccctgaggtcacatgcgtggtggt ggacgtgagccacgaagaccctgaggtcaagttcaactggtacgtggacggcgtggaggtgcataatgccaag acaaagccgcgggaggagcagtacaacagcacgtaccgtgtggtcagcgtcctcaccgtcctgcaccaggact ggctgaatggcaaggagtacaagtgcaaggtctccaacaaagccctcccagcccccatcgagaaaaccatctc caaagccaaagggcagccccgagaaccacaggtgtacaccctgcccccatcccgggaggagatgaccaagaac caggtcagcctgacctgcctggtcaaaggcttctatcccagcgacatcgccgtggagtgggagagcaatgggc agccggagaacaactacaagaccacgcctcccgtgctggactccgacggctccttccagctctacagcaagct caccgtggacaagagcaggtggcagcaggggaacgtcttctcatgctccgtgatgcatgaggctctgcacaac cactacacgcagaagagcctctccctgtctccgggtaaatgataa (amino acids)

(SEQ ID NO: 281)
EPKSCDKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLDSDGSFQLYSKLTVDKSR

WQQGNVFSCSVMHEALHNHYTQKSLSLSPGK**

Human IgG1 Fc T394D sequence:
(DNA)

(SEQ ID NO: 282)
gagcccaaatcttgtgacaaaactcacacatgcccaccgtgcccagcacctgaactcctggggggaccgtcag tcttcctcttccccccaaaacccaaggacaccctcatgatctcccggacccctgaggtcacatgcgtggtggt ggacgtgagccacgaagaccctgaggtcaagttcaactggtacgtggacggcgtggaggtgcataatgccaag -continued

```
acaaagccgcgggaggagcagtacaacagcacgtaccgtgtggtcagcgtcctcaccgtcctgcaccaggact
ggctgaatggcaaggagtacaagtgcaaggtctccaacaaagccctcccagcccccatcgagaaaaccatctc
caaagccaaagggcagccccgagaaccacaggtgtacaccctgcccccatcccgggaggagatgaccaagaac
caggtcagcctgacctgcctggtcaaaggcttctatcccagcgacatcgccgtggagtgggagagcaatgggc
agccggagaacaactacaagaccgaccctcccgtgctggactccgacggctccttcttcctctacagcaagct
caccgtggacaagagcaggtggcagcaggggaacgtcttctcatgctccgtgatgcatgaggctctgcacaac
cactacacgcagaagagcctctccctgtctccgggtaaatgataa
```

(amino acids)                                                    (SEQ ID NO: 283)

EPKSCDKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVY

TLPPSREEMTKNQVSLTCLVKGFYPSDIAVEWESNGQPENNYKTDPPVLDSDGSFFLYSKLTVDKSR

WQQGNVFSCSVMHEALHNHYTQKSLSLSPGK**

Human IgG1 Fc T366W/L368W sequence:
(DNA)
                                                                 (SEQ ID NO: 284)

```
gagcccaaatcttgtgacaaaactcacacatgcccaccgtgcccagcacctgaactcctggggggaccgtcag
tcttcctcttccccccaaaacccaaggacaccctcatgatctcccggacccctgaggtcacatgcgtggtggt
ggacgtgagccacgaagaccctgaggtcaagttcaactggtacgtggacggcgtggaggtgcataatgccaag
acaaagccgcgggaggagcagtacaacagcacgtaccgtgtggtcagcgtcctcaccgtcctgcaccaggact
ggctgaatggcaaggagtacaagtgcaaggtctccaacaaagccctcccagcccccatcgagaaaaccatctc
caaagccaaagggcagccccgagaaccacaggtgtacaccctgcccccatcccgggaggagatgaccaagaac
caggtcagcctgtggtgctgggtcaaaggcttctatcccagcgacatcgccgtggagtgggagagcaatgggc
agccggagaacaactacaagaccacgcctcccgtgctggactccgacggctccttcttcctctacagcaagct
caccgtggacaagagcaggtggcagcaggggaacgtcttctcatgctccgtgatgcatgaggctctgcacaac
cactacacgcagaagagcctctccctgtctccgggtaaatgataa
```

(amino acids)                                                    (SEQ ID NO: 285)

EPKSCDKTHTCPPCPAPELLGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVY

TLPPSREEMTKNQVSLWCWVKGFYPSDIAVEWESNGQPENNYKTTPPVLDSDGSFFLYSKLTVDKSR

WQQGNVFSCSVMHEALHNHYTQKSLSLSPGK**

Human IgG1 Fc T364R/L368R sequence:
(DNA)
                                                                 (SEQ ID NO: 286)

```
gagcccaaatcttgtgacaaaactcacacatgcccaccgtgcccagcacctgaactcctggggggaccgtcag
tcttcctcttccccccaaaacccaaggacaccctcatgatctcccggacccctgaggtcacatgcgtggtggt
ggacgtgagccacgaagaccctgaggtcaagttcaactggtacgtggacggcgtggaggtgcataatgccaag
acaaagccgcgggaggagcagtacaacagcacgtaccgtgtggtcagcgtcctcaccgtcctgcaccaggact
ggctgaatggcaaggagtacaagtgcaaggtctccaacaaagccctcccagcccccatcgagaaaaccatctc
caaagccaaagggcagccccgagaaccacaggtgtacaccctgcccccatcccgggaggagatgaccaagaac
caggtcaggctgacctgcagggtcaaaggcttctatcccagcgacatcgccgtggagtgggagagcaatgggc
agccggagaacaactacaagaccacgcctcccgtgctggactccgacggctccttcttcctctacagcaagct
caccgtggacaagagcaggtggcagcaggggaacgtcttctcatgctccgtgatgcatgaggctctgcacaac
cactacacgcagaagagcctctccctgtctccgggtaaatgataa
```

(amino acids)

(SEQ ID NO: 287)
EPKSCDKTHTCPPCPAPELLGGPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVY
TLPPSREEMTKNQVRLTCRVKGFYPSDIAVEWESNGQPENNYKTTPPVLDSDGSFFLYSKLTVDKSR
WQQGNVFSCSVMHEALHNHYTQKSLSLSPGK**

Human IgG1 Fc hingeless sequence:
(DNA)

(SEQ ID NO: 288)
gcacctgaactcctgggggaccgtcagtcttcctcttccccccaaaacccaaggacaccctcatgatctccc
ggacccctgaggtcacatgcgtggtggtggacgtgagccacgaagaccctgaggtcaagttcaactggtacgt
ggacggcgtggaggtgcataatgccaagacaaagccgcgggaggagcagtacaacagcacgtaccgtgtggtc
agcgtcctcaccgtcctgcaccaggactggctgaatggcaaggagtacaagtgcaaggtctccaacaaagccc
tcccagcccccatcgagaaaaccatctccaaagccaaagggcagccccgagaaccacaggtgtacaccctgcc
cccatcccgggaggagatgaccaagaaccaggtcagcctgacctgcctggtcaaaggcttctatcccagcgac
atcgccgtggagtgggagagcaatgggcagccggagaacaactacaagaccacgcctcccgtgctggactccg
acggctccttcttcctctacagcaagctcaccgtggacaagagcaggtggcagcaggggaacgtcttctcatg
ctccgtgatgcatgaggctctgcacaaccactacacgcagaagagcctctccctgtctccgggtaaatgataa (amino acids)

(SEQ ID NO: 289)
APELLGGPSVFLFPPKPKDTLMISRTPEVTCVVVDVSHEDPEVKFNWYVDGVEVHNAKTKPREEQYNSTYRVV
SVLTVLHQDWLNGKEYKCKVSNKALPAPIEKTISKAKGQPREPQVYTLPPSREEMTKNQVSLTCLVKGFYPSD
IAVEWESNGQPENNYKTTPPVLDSDGSFFLYSKLTVDKSRWQQGNVFSCSVMHEALHNHYTQKSLSLSPGK**

Human IgG1 G237A FC sequence:
(DNA)

(SEQ ID NO: 290)
gagcccaaatcttgtgacaaaactcacacatgcccaccgtgcccagcacctgaactcctgggggccc
cgtcagtcttcctcttccccccaaaacccaaggacaccctcatgatctcccggacccctgaggtcac
atgcgtggtggtggacgtgagccacgaagaccctgaggtcaagttcaactggtacgtggacggcgtg
gaggtgcataatgccaagacaaagccgcgggaggagcagtacaacagcacgtaccgtgtggtcagcg
tcctcaccgtcctgcaccaggactggctgaatggcaaggagtacaagtgcaaggtctccaacaaagc
cctcccagcccccatcgagaaaaccatctccaaagccaaagggcagccccgagaaccacaggtgtac
accctgcccccatcccgggaggagatgaccaagaaccaggtcagcctgacctgcctggtcaaaggct
tctatcccagcgacatcgccgtggagtgggagagcaatgggcagccggagaacaactacaagaccac
gcctcccgtgctggactccgacggctccttcttcctctacagcaagctcaccgtggacaagagcagg
tggcagcaggggaacgtcttctcatgctccgtgatgcatgaggctctgcacaaccactacacgcaga
agagcctctccctgtctccgggtaaa (amino acids)

(SEQ ID NO: 291)
EPKSCDKTHTCPPCPAPELLGAPSVFLFPPKPKDTLMISRTPEVTCVVVDVSHEDPEVKFNWYVDGV
EVHNAKTKPREEQYNSTYRVVSVLTVLHQDWLNGKEYKCKVSNKALPAPIEKTISKAKGQPREPQVY
TLPPSREEMTKNQVSLTCLVKGFYPSDIAVEWESNGQPENNYKTTPPVLDSDGSFFLYSKLTVDKSR
WQQGNVFSCSVMHEALHNHYTQKSLSLSPGK

Human IgG1 L234A/L235A FC sequence:
(DNA)

(SEQ ID NO: 292)
gagcccaaatcttgtgacaaaactcacacatgcccaccgtgcccagcacctgaagccgccggggac
cgtcagtcttcctcttccccccaaaacccaaggacaccctcatgatctcccggacccctgaggtcac
atgcgtggtggtggacgtgagccacgaagaccctgaggtcaagttcaactggtacgtggacggcgtg

```
gaggtgcataatgccaagacaaagccgcgggaggagcagtacaacagcacgtaccgtgtggtcagcg tcctcaccgtcctgcaccaggactggctgaatggcaaggagtacaagtgcaaggtctccaacaaagc cctcccagcccccatcgagaaaaccatctccaaagccaagggcagccccgagaaccacaggtgtac accctgcccccatcccgggaggagatgaccaagaaccaggtcagcctgacctgcctggtcaaaggct tctatcccagcgacatcgccgtggagtgggagagcaatgggcagccggagaacaactacaagaccac gcctcccgtgctggactccgacggctccttcttcctctacagcaagctcaccgtggacaagagcagg tggcagcaggggaacgtcttctcatgctccgtgatgcatgaggctctgcacaaccactacacgcaga agagcctctccctgtctccgggtaaa
```
(amino acids)

(SEQ ID NO: 293)

EPKSCDKTHTCPPCPAPEAAGGPSVFLFPPKPKDTLMISRTPEVTCVVVDVSHEDPEVKFNWYVDGV

EVHNAKTKPREEQYNSTYRVVSVLTVLHQDWLNGKEYKCKVSNKALPAPIEKTISKAKGQPREPQVY

TLPPSREEMTKNQVSLTCLVKGFYPSDIAVEWESNGQPENNYKTTPPVLDSDGSFFLYSKLTVDKSR

WQQGNVFSCSVMHEALHNHYTQKSLSLSPGK

CAR-T E6 CD3z sequence:
(DNA)

(SEQ ID NO: 294)
```
atggccctgccgtgaccgctttgctgctccccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccggggggggcacttacatctattaccccgactcagtcaaggggagattta ccatttcacgagacaacgctaagaatacctgtatttgcagatgaattctctgagagcagaggacac agctgtttactattgtacccgcgacaactatggcaggaactacgactacggtatggactattgggga caagggacattggttacagtgagcagtggcggcggggggcagcggaggaggaggcagcggtgggggg gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaaacgacaacccccg gcccccagaccaccaacgccagcccccaccatcgccagccaacccctgtctctgagaccagaagcct gtaggcctgccgccggtggagctgtgcacacaagaggactggatttcgcctgtgatatctacatttg ggccccgctcgcaggcacatgtggagtgctcctcctctcccctggtgattaccctgtactgccgcgtt aagttctcccgatcagccgacgcgcctgcttacaagcagggccagaaccaactgtacaacgagctga atctcggtagacgggaagagtacgacgtgttggacaaacggagaggccgcgacccagaaatgggcgg caagcctcgcaggaaaaaccccaggagggactgtacaatgagttgcagaaagataagatggcagaa gcttatagcgagatcggaatgaaggggaaaggagacgagggaaaggacacgacggcctttatcagg gcctgtccacagcaacaaaagatacgtatgacgccctccatatgcaggcacttccaccacggtgata
a
```
(amino acids)

(SEQ ID NO: 295)
MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKTTTP

APRPPTPAPTIASQPLSLRPEACRPAAGGAVHTRGLDFACDIYIWAPLAGTCGVLLLSLVITLYCRV

KFSRSADAPAYKQGQNQLYNELNLGRREEYDVLDKRRGRDPEMGGKPRRKNPQEGLYNELQKDKMAE

AYSEIGMKGERRRGKGHDGLYQGLSTATKDTYDALHMQALPPR**

**

CAR-T E6 CD3z gBLOCK sequence:
(DNA)
(SEQ ID NO: 296)

tggagctgtgcacacaagaggactggatttcgcctgtgatatctacatttgggccccgctcgcaggcacatgt ggagtgctcctcctctccctggtgattaccctgtactgccgcgttaagttctcccgatcagccgacgcgcctg cttacaagcagggccagaaccaactgtacaacgagctgaatctcggtagacgggaagagtacgacgtgttgga caaacgagaggccgcgacccagaaatgggcggcaagcctcgcaggaaaaaccccaggagggactgtacaat gagttgcagaaagataagatggcagaagcttatagcgagatcggaatgaaggggggaaggagacgagggaaag gacacgacggcctttatcagggcctgtccacagcaacaaaagatacgtatgacgccctccatatgcaggcact tccaccacggtgataagtttaaacccgctgatcagcctcgactgtgc CAR-T E6 CD28/CD3z sequence:
(DNA)
(SEQ ID NO: 297)

atggccctgcccgtgaccgctttgctgctcccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccggggggggcacttacatctattacccgactcagtcaaggggagattta ccatttcacgagacaacgctaagaatacctgtatttgcagatgaattctctgagagcagaggacac agctgtttactattgtacccgcgacaactatggcaggaactacgactacggtatggactattggga caagggacattggttacagtgagcagtggcggcggggggcagcggaggaggaggcagcggtgggggg gcagcgagatagtgctcacgcagtcacccgcgactctcagtctctcacctggggaacgagctaccct gacgtgctctgctacctcctcagtgtcatatattcactggtatcagcaacggcccggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaaacgacaaccccg gccccagaccaccaacgccagcccccaccatcgccagccaaccctgtctctgagaccagaagcc gtaggcctgccgccggtggagctgtgcacacaagaggactggatttcgcctgtgatatctacatttg ggccccgctcgcaggcacatgtggagtgctcctcctctccctggtgattaccctgtactgcagaagc aagcggtctcggctcctgcattctgattacatgaacatgaccccaagaagaccaggccccaccagga aacattaccagccctacgctccgccacgcgacttcgctgcctaccggtcccgcgttaagttctcccg atcagccgacgcgcctgcttacaagcagggccagaaccaactgtacaacgagctgaatctcggtaga cgggaagagtacgacgtgttggacaaacgagaggccgcgacccagaaatgggcggcaagcctcgca ggaaaaaccccaggagggactgtacaatgagttgcagaaagataagatggcagaagcttatagcga gatcggaatgaaggggggaaggagacgagggaaaggacacgacggcctttatcagggcctgtccaca gcaacaaaagatacgtatgacgccctccatatgcaggcacttccaccacggtgataa (amino acids)
(SEQ ID NO: 298)

MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

-continued

RLLIYSTSNLASGIPARFSGSGSGSDYTLTISSLEPEDFAVYYCQQRSSSPFTFGSGTKVEIKTTTP

APRPPTPAPTIASQPLSLRPEACRPAAGGAVHTRGLDFACDIYIWAPLAGTCGVLLLSLVITLYCRS

KRSRLLHSDYMNMTPRRPGPTRKHYQPYAPPRDFAAYRSRVKFSRSADAPAYKQGQNQLYNELNLGR

REEYDVLDKRRGRDPEMGGKPRRKNPQEGLYNELQKDKMAEAYSEIGMKGERRRGKGHDGLYQGLST

ATKDTYDALHMQALPPR\*\*

CAR-T E6 CD28/CD3z g BLOCK sequence:
(DNA)

(SEQ ID NO: 299)

tggagctgtgcacacaagaggactggatttcgcctgtgatatctacatttgggccccgctcgcaggcacatgt ggagtgctcctcctctccctggtgattaccctgtactgcagaagcaagcggtctcggctcctgcattctgatt acatgaacatgaccccaagaagaccaggccccaccaggaaacattaccagccctacgctccgccacgcgactt cgctgcctaccggtcccgcgttaagttctcccgatcagccgacgcgcctgcttacaagcagggccagaaccaa ctgtacaacgagctgaatctcggtagacgggaagagtacgacgtgttggacaaacggagaggccgcgacccag aaatgggcggcaagcctcgcaggaaaaaccccaggagggactgtacaatgagttgcagaaagataagatggc agaagcttatagcgagatcggaatgaaggggaaaggagacgagggaaaggacacgacggcctttatcagggc ctgtccacagcaacaaaagatacgtatgacgcccctccatatgcaggcacttccaccacggtgataagtttaaa cccgctgatcagcctcgactgtgc CAR-T E6 4-1BB/CD3z sequence:
(DNA)

(SEQ ID NO: 300)

atggccctgcccgtgaccgctttgctgctcccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccgggggggcacttacatctattaccccgactcagtcaaggggagattta ccatttcacgagacaacgctaagaatacccctgtatttgcagatgaattctctgagagcagaggacac agctgtttactattgtacccgcgacaactatggcaggaactacgactacggtatggactattggga caagggacattggttacagtgagcagtggcggcggggcagcggaggaggaggcagcggtgggggg gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaaacgacaacccg gcccccagaccaccaacgccagcccccaccatcgccagccaacccctgtctctgagaccagaagcct gtaggcctgccgccggtggagctgtgcacacaagaggactggatttcgcctgtgatatctacatttg ggccccgctcgcaggcacatgtggagtgctcctcctctccctggtgattaccctgtactgcaaaagg ggccgcaaaaaactcctttacattttaagcagccttttatgaggccagtacagacgactcaagagg aagacgggtgctcatgccgctttcctgaggaggaggaaggagggtgcgaactgcgcgttaagttctc ccgatcagccgacgcgcctgcttacaagcagggccagaaccaactgtacaacgagctgaatctcggt agacgggaagagtacgacgtgttggacaaacggagaggccgcgacccagaaatgggcggcaagcctc gcaggaaaaaccccaggagggactgtacaatgagttgcagaaagataagatggcagaagcttatag cgagatcggaatgaaggggaaaggagacgagggaaaggacacgacggcctttatcagggcctgtcc acagcaacaaaagatacgtatgacgcccctccatatgcaggcacttccaccacggtgataa -continued (amino acids)

(SEQ ID NO: 301)
MALPVTALLLPLALLLHAARPEVQLVESGGGLVKPGGSLRLSCAASGFTFSRYGMSWVRQAPGKRLEWVSTIS

GGGTYIYYPDSVKGRFTISRDNAKNTLYLQMNSLRAEDTAVYYCTRDNYGRNYDYGMDYWGQGTLVTVSSGGG

GSGGGGSGGGGSEIVLTQSPATLSLSPGERATLTCSATSSVSYIHWYQQRPGQSPRLLIYSTSNLASGIPARF

SGSGSGSDYTLTISSLEPEDFAVYYCQQRSSSPFTFGSGTKVEIKTTTPAPRPPTPAPTIASQPLSLRPEACR

PAAGGAVHTRGLDFACDIYIWAPLAGTCGVLLLSLVITLYCKRGRKKLLYIFKQPFMRPVQTTQEEDGCSCRF

PEEEEGGCELRVKFSRSADAPAYKQGQNQLYNELNLGRREEYDVLDKRRGRDPEMGGKPRRKNPQEGLYNELQ

KDKMAEAYSEIGMKGERRRGKGHDGLYQGLSTATKDTYDALHMQALPPR**

CAR-T E6 4-1BB/CD3z gBLOCK sequence:
(DNA)

(SEQ ID NO: 302)
tggagctgtgcacacaagaggactggatttcgcctgtgatatctacatttgggccccgctcgcaggcacatgt ggagtgctcctcctctccctggtgattaccctgtactgcaaaaggggccgcaaaaaactcctttacatttta agcagccttttatgaggccagtacagacgactcaagaggaagacgggtgctcatgccgctttcctgaggagga ggaaggagggtgcgaactgcgcgttaagttctcccgatcagccgacgcgcctgcttacaagcagggccagaac caactgtacaacgagctgaatctcggtagacgggaagagtacgacgtgttggacaaacgagaggccgcgacc cagaaatgggcggcaagcctcgcaggaaaaaccccaggagggactgtacaatgagttgcagaaagataagat ggcagaagcttatagcgagatcggaatgaaggggggaaggagacgagggaaaggacacgacggcctttatcag ggcctgtccacagcaacaaaagatacgtatgacgccctccatatgcaggcacttccaccacggtgataagttt aaacccgctgatcagcctcgactgtgc CAR-T E6 CD28/4-1BB/CD3z sequence:
(DNA)

(SEQ ID NO: 303)
atggccctgcccgtgaccgctttgctgctcccctggcgctgctgctgcacgccgccaggccagagg tccagctggttgagagtggcgtgggctggttaagcctggcggctccctgcggctgagctgcgccgc gagtggatttactttcagccgatatgggatgagttgggtgcggcaagctcccgggaagaggctggaa tgggtctcaacaatctccggggggggcacttacatctattaccccgactcagtcaaggggagattta ccatttcacgagacaacgctaagaatacgctgtatttgcagatgaattctctgagagcagaggacac agctgtttactattgtacccgcgacaactatggcaggaactacgactacggtatggactattggga caagggacattggttacagtgagcagtggcggcggggcagcggaggaggaggcagcggtggggggg gcagcgagatagtgctcacgcagtcacccgcgactctcagtctctcacctggggaacgagctaccct gacgtgctctgctacctcctcagtgtcatatattcactggtatcagcaacggcccgggcagtccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaaacgacaacccg gcccccagaccaccaacgccagcccccaccatcgccagccaaccctgtctctgagaccagaagcct gtaggcctgccgccggtggagctgtgcacacaagaggactggatttcgcctgtgatatctacatttg ggccccgctcgcaggcacatgtggagtgctcctcctctccctggtgattaccctgtactgcagaagc aagcggtctcggctcctgcattctgattacatgaacatgaccccaagaagaccaggccccaccagga aacattaccagcccta cgctccgccacgcgacttcgctgcctaccggtccaaaaggggccgcaaaaa actcctttacatttttaagcagccttttatgaggccagtacagacgactcaagaggaagacgggtgc tcatgccgctttcctgaggaggaggaaggagggtgcgaactgcgcgttaagttctcccgatcagccg acgcgcctgcttacaagcagggccagaaccaactgtacaacgagctgaatctcggtagacgggaaga -continued

```
gtacgacgtgttggacaaacggagaggccgcgacccagaaatgggcggcaagcctcgcaggaaaaac ccccaggagggactgtacaatgagttgcagaaagataagatggcagaagcttatagcgagatcggaa tgaaggggaaaggagacgagggaaaggacacgacggcctttatcagggcctgtccacagcaacaaa agatacgtatgacgccctccatatgcaggcacttccaccacggtgataa
```

(amino acids)

(SEQ ID NO: 304)

MALPVTALLLPLALLLHAARPEVQLVESGGGLVKPGGSLRLSCAASGFTFSRYGMSWVRQAPGKRLEWVSTIS

GGGTYIYYPDSVKGRFTISRDNAKNTLYLQMNSLRAEDTAVYYCTRDNYGRNYDYGMDYWGQGTLVTVSSGGG

GSGGGGSGGGGSEIVLTQSPATLSLSPGERATLTCSATSSVSYIHWYQQRPGQSPRLLIYSTSNLASGIPARF

SGSGSGSDYTLTISSLEPEDFAVYYCQQRSSSPFTFGSGTKVEIKTTTPAPRPPTPAPTIASQPLSLRPEACR

PAAGGAVHTRGLDFACDIYIWAPLAGTCGVLLLSLVITLYCRSKRSRLLHSDYMNMTPRRPGPTRKHYQPYAP

PRDFAAYRSKRGRKKLLYIFKQPFMRPVQTTQEEDGCSCRFPEEEEGGCELRVKFSRSADAPAYKQGQNQLYN

ELNLGRREEYDVLDKRRGRDPEMGGKPRRKNPQEGLYNELQKDKMAEAYSEIGMKGERRRGKGHDGLYQGLST

ATKDTYDALHMQALPPR**

CAR-T E6 CD28/4-1BB/CD3z gBLOCK sequence:
(DNA)

(SEQ ID NO: 305)

```
atagggagacccaagctggctagttaagcttggtaccgagggccaccatggccctgcccgtgaccgc tttgctgctcccctggcgctgctgctgcacgccgccaggccagaggtccagctggttgagagtggc ggtgggctggttaagcctggcggctccctgcggctgagctgcgccgcgagtggatttactttcagcc gatatgggatgagttgggtgcggcaagctcccgggaagaggctggaatgggtctcaacaatctccgg gggggcacttacatctattaccccgactcagtcaaggggagatttaccatttcacgagacaacgct aagaatacccctgtatttgcagatgaattctctgagagcagaggacacagctgtttactattgtaccc gcgacaactatggcaggaactacgactacggtatggactattggggacaagggacattggttacagt gagcagtggcggcggggcagcggaggaggaggcagcggtggggggggcagcgagatagtgctcacg cagtcacccgcgactctcagtctctcacctggggaacgagctaccctgacgtgctctgctacctcct cagtgtcatatattcactggtatcagcaacggcccgggcagtcccctagattgctcatttatagtac ctctaatctggcctcaggtatccctgcacgattttctggatctggttcaggttctgattacaccctc actatctctagcctggagcctgaagactttgccgtttattactgccagcagaggtctagctccccat tcaccttgggagtgggaccaaggttgaaattaaaacgacaaccccggccccagaccaccaacgcc agcccccaccatcgccagccaaccctgtctctgagaccagaagcctgtaggcctgccgccggtgga gctgtgcacacaagaggactggatttcgcctgtgatatctacatttgggccccgctcgcaggcacat gtggagtgctcctcctctccctggtgattaccctgtactgcagaagcaagcggtctcggctcctgca ttctgattacatgaacatgacccccaagaagaccaggcccccaccaggaaacattaccagccctacgct ccgccacgcgacttcgctgcctaccggtccaaaaggggccgcaaaaaactcctttacatttttaagc agccttttatgaggccagtacagacgactcaagaggaagacgggtgctcatgccgctttcctgagga ggaggaaggagggtgcgaactgcgcgttaagttctcccgatcagccgacgcgcctgcttacaagcag ggccagaaccaactgtacaacgagctgaatctcggtagacgggaagagtacgacgtgttggacaaac ggagaggccgcgacccagaaatgggcggcaagcctcgcaggaaaaaccccaggagggactgtacaa tgagttgcagaaagataagatggcagaagcttatagcgagatcggaatgaaggggaaaggagacga gggaaaggacacgacggcctttatcagggcctgtccacagcaacaaaagatacgtatgacgccctcc atatgcaggcacttccaccacggtgataagtttaaacccgctgatcagcctcgactgtgc
```

CAR-T C2 CD28/4-1BB/CD3z sequence:
(DNA)

(SEQ ID NO: 306)
atggccttgccagtgacggccctgctgctgccattggctcttctgttgcacgctgccaggcctgaagtgcagc tcgtagagagtggcggggggactggtgaagcccggtggaagcctcagactcagttgcgccgcctcaggtttcac ttttcaggttacgccatgtcctgggtaagacaggcaccggggaaaggactcgagtgggtgtctactatcagc tcaggaggcacttatatatattatcctgactctgtaaaaggccgatttacgatttctcgcgacaatgcaaaga actccctctacctccaaatgaacagtcttagggcagaagacactgctgtatactattgtgcacgcctggcgg cgacaactactacgagtactttgacgtgtgggggaaagggactaccgtgacagtttcaagggaggaggtggc tcaggtggaggcgggtcaggggggggaggaagtgatattgtgctcacacaatccccagcctccctggctgtgt ctccggccaacgcgctacaattacatgtcgggcctccaaaagcgtgagcaccagcggctacagctacatgca ctggtatcaacagaaaccaggacaaccccccaaactgttgatttatctgcttcaaacttggagtccggcgtg cctgcgcgcttttcagggagtgggagcggcacagattttacgctgactatcaaccccgtagaagcaaacgata cagcgaattattattgtcaacattcccgggaactccccttacgttcggcggggggcacaaaggtcgaaattaa gagaaccacgacaaccccggcccccagaccaccaacgccagcccccaccatcgccagccaaccccctgtctctg agaccagaagcctgtaggcctgccgccggtggagctgtgcacacaagaggactggatttcgcctgtgatatct acatttgggccccgctcgcaggcacatgtggagtgctcctcctctccctggtgattaccctgtactgcagaag caagcggtctcggctcctgcattctgattacatgaacatgaccccaagaagaccaggccccaccaggaaacat taccagccctacgctccgccacgcgacttcgctgcctaccggtccaaaaggggccgcaaaaaactcctttaca ttttaagcagcctttatgaggccagtacagacgactcaagaggaagacgggtgctcatgccgctttcctga ggaggaggaaggagggtgcgaactgcgcgttaagttctcccgatcagccgacgcgcctgcttacaagcagggc cagaaccaactgtacaacgagctgaatctcggtagacgggaagagtacgacgtgttggacaaacggagaggcc gcgacccagaaatgggcggcaagcctcgcaggaaaaaccccaggagggactgtacaatgagttgcagaaga taagatggcagaagcttatagcgagatcggaatgaaggggggaaggagacgagggaaaggacacgacggcctt tatcagggcctgtccacagcaacaaaagatacgtatgacgccctccatatgcaggcacttccaccacggtgat aa (amino acids)

(SEQ ID NO: 307)
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYFDVWGKGTTVTVSSGGGGSGGGGSGGGGSDIVLTQSPAS

LAVSPGQRATITCRASKSVSTSGYSYMHWYQQKPGQPPKLLIYLASNLESGVPARFSGSGSGTDFTLTINPVE

ANDTANYYCQHSRELPFTFGGGTKVEIKRTTTTPAPRPPTPAPTIASQPLSLRPEACRPAAGGAVHTRGLDFA

CDIYIWAPLAGTCGVLLLSLVITLYCRSKRSRLLHSDYMNMTPRRPGPTRKHYQPYAPPRDFAAYRSKRGRKK

LLYIFKQPFMRPVQTTQEEDGCSCRFPEEEEGGCELRVKFSRSADAPAYKQGQNQLYNELNLGRREEYDVLDK

RRGRDPEMGGKPRRKNPQEGLYNELQKDKMAEAYSEIGMKGERRRGKGHDGLYQGLSTATKDTYDALHMQALP

PR**

CAR-T C2-1 gBLOCK sequence:
(DNA)

(SEQ ID NO: 308)
atagggagacccaagctggctagttaagcttggtaccgagggccaccatggccttgccagtgacggccctgct gctgccattggctcttctgttgcacgctgccaggcctgaagtgcagctcgtagagagtggcggggggactggtg aagcccggtggaagcctcagactcagttgcgccgcctcaggtttcacttttcaggttacgccatgtcctggg taagacaggcaccggggaaaggactcgagtgggtgtctactatcagctcaggaggcacttatatatattatcc tgactctgtaaaaggccgatttacgatttctcgcgacaatgcaaagaactccctctacctccaaatgaacagt -continued cttagggcagaagacactgctgtatactattgtgcacgcctcggcggcgacaactactacgagtactttgacg tgtgggggaaagggactaccgtgacagtttcaagcggaggaggtggctcaggtggaggcgggtcagggggggg aggaagtgatattgtgctcacacaatccccagcctccctggc CAR-T C2-2 gBLOCK sequence:
(DNA)
(SEQ ID NO: 309)
aagtgatattgtgctcacacaatccccagcctccctggctgtgtctcccggccaacgcgctacaattacatgt cgggcctccaaaagcgtgagcaccagcggctacagctacatgcactggtatcaacagaaaccaggacaacccc ccaaactgttgatttatctcgcttcaaacttggagtccggcgtgcctgcgcgcttttcagggagtgggagcgg cacagattttacgctgactatcaaccccgtagaagcaaacgatacagcgaattattattgtcaacattcccgg gaactcccctttacgttcggcggggggcacaaaggtcgaaattaagagaaccacgacaaccccggcccccagac caccaacgccagccccaccatcgccagccaacccctgtctctgagaccagaagcctgtaggcctgccgccgg tggagctgtgcacacaagaggactggatttcgcctgtgatatctacatttgggccccgctcgcaggcacatgt ggagtgc CAR E6 Fc/8/4-1BB/CD3z sequence:
(DNA)
(SEQ ID NO: 310)
atggccctgcccgtgaccgctttgctgctcccccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccggggggggcacttacatctattaccccgactcagtcaaggggagattta ccatttcacgagacaacgctaagaataccctgtatttgcagatgaattctctgagagcagaggacac agctgtttactattgtacccgcgacaactatggcaggaactacgactacggtatggactattggga caagggacattggttacagtgagcagtggcggcggggcagcggaggaggaggcagcggtggcggag gcagcgagatagtgctcacgcagtcacccgcgactctcagtctctcacctggggaacgagctaccct gacgtgctctgctacctcctcagtgtcatatattcactggtatcagcaacgcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcaccttgggagtgggaccaaggttgaaattaagagcccaaatct tgtgacaaaactcacacatgcccaccgtgcccagcacctgaactcctggggggaccgtcagtcttcc tcttccccccaaaacccaaggacaccctcatgatctcccggacccctgaggtcacatgcgtggtggt ggacgtgagccacgaagaccctgaggtcaagttcaactggtacgtggacggcgtggaggtgcataat gccaagacaaagccgcgggaggagcagtacaacagcacgtaccgtgtggtcagcgtcctcaccgtcc tgcaccaggactggctgaatggcaaggagtacaagtgcaaggtctccaacaaagccctcccagcccc catcgagaaaaccatctccaaagccaaagggcagccccgagaaccacaggtgtacaccctgccccca tcccgggaggagatgaccaagaaccaggtcagcctgacctgcctggtcaaaggcttctatcccagcg acatcgccgtggagtgggagagcaatgggcagccggagaacaactacaagaccacgcctcccgtgct ggactccgacggctccttcttcctctacagcaagctcaccgtggacaagagcaggtggcagcagggg aacgtcttctcatgctccgtgatgcatgaggctctgcacaaccactacacgcagaagagcctctccc tgtctccgggtaaaatctacatttgggccccgctcgcaggcacatgtggagtgctcctcctctccct ggtgattaccctgtactgcaaaaggggccgcaaaaaactcctttacattttttaagcagccttttatg aggccagtacagacgactcaagaggaagacgggtgctcatgccgctttcctgaggaggaggaaggag ggtgcgaactgcgcgttaagttctcccgatcagccgacgcgcctgcttacaagcagggccagaacca actgtacaacgagctgaatctcggtagacgggaagagtacgacgtgttggacaaacggagaggccgc -continued

```
gacccagaaatgggcggcaagcctcgcaggaaaaaccccagga gggactgtacaatgagttgcaga aagataagatggcagaagcttatagcgagatcggaatgaaggggg aaaggagacgagggaaaggaca cgacggcctttatcagggcctgtccacagcaacaaaagatacgta tgacgccctccatatgcaggca cttccaccacggtgataa
```

(amino acids)

(SEQ ID NO: 311)

```
MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKEPKS

CDKTHTCPPCPAPELLGGPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGSFFLYSKLTVDKSRWQQG

NVFSCSVMHEALHNHYTQKSLSLSPGKIYIWAPLAGTCGVLLLSLVITLYCKRGRKKLLYIFKQPFM

RPVQTTQEEDGCSCRFPEEEEGGCELRVKFSRSADAPAYKQGQNQLYNELNLGRREEYDVLDKRRGR

DPEMGGKPRRKNPQEGLYNELQKDKMAEAYSEIGMKGERRRGKGHDGLYQGLSTATKDTYDALHMQA

LPPR**
```

E6 CAR pCDH gBLOCK sequence:
(DNA)

(SEQ ID NO: 312)

```
acgctgttttgacctccatagaagattctagagctagctgtagagcttggtaccgagggccaccatg gccctgcccgtgaccgctttgctgctccccctggcgctgctgctgcacgccgccaggccagaggtcc agctggttgagagtggcggtgggctggttaagcctggcggctccctgcggctgagctgcgccgcgag tggatttactttcagccgatatgggatgagttgggtgcggcaagctcccgggaagaggctggaatgg gtctcaacaatctccggggggggcacttacatctattaccccgactcagtcaaggggagatttacca tttcacgagacaacgctaagaatacccctgtatttgcagatgaattctctgagagcagaggacacagc tgtttactattgtacccgcgacaactatggcaggaactacgactacggtatggactattggggacaa gggacattggttacagtgagcagtggcggcggggcagcggaggaggaggcagcggtggcggaggca gcgagatagtgctcacgcagtcacccgcgactctcagtctctcacctggggaacgagctaccctgac gtgctctgctacctcctcagtgtcatatattcactggtatcagcaacggcccgggcagtcccctaga ttgctcatttatagtacctctaatctggcctcaggtatccctgc
```

E6 CAR Fc pCDH gBLOCK sequence:
(DNA)

(SEQ ID NO: 313)

```
agtacctctaatctggcctcaggtatccctgcacgattttctggatctggttcaggttctgattaca ccctcactatctctagcctggagcctgaagactttgccgtttattactgccagcagaggtctagctc cccattcacctttgggagtgggaccaaggttgaaattaaagagcccaaatcttgtgacaaaactcac acatgcccaccgtgcccagcacctgaactcctggggggaccgtcagtcttcctcttccccccaaaac ccaaggacaccctcatgatctcccggacccctgaggtcacatgcgtggtggtggacgtgagccacga agaccctgaggtcaagttcaactggtacgtggacggcgtggaggtgcataatgccaagacaaagccg cgggaggagcagtacaacagcacgtaccgtgtggtcagcgtcctcaccgtcctgcaccaggactggc tgaatggcaaggagtacaagtgcaaggtctccaacaaagccctcccagcccccatcgagaaaaccat
```

```
ctccaaagccaaagggcagccccgagaaccacaggtgtacaccctgcccccatcccgggaggagatg accaagaaccaggtcagcctgacctgcctggtcaaaggcttctatcccagcgacatcgccgtggagt gggagagcaatgggcagccggagaacaactacaagaccacgcctcccgtgctg
```

E6 CAR 8BB3 pCDH gBLOCK sequence:
(DNA)

(SEQ ID NO: 314)
```
agaacaactacaagaccacgcctcccgtgctggactccgacggctccttcttcctctacagcaagct caccgtggacaagagcaggtggcagcaggggaacgtcttctcatgctccgtgatgcatgaggctctg cacaaccactacacgcagaagagcctctccctgtctccgggtaaaatctacatttgggccccgctcg caggcacatgtggagtgctcctcctctccctggtgattaccctgtactgcaaaagggggccgcaaaaa actcctttacatttttaagcagccttttatgaggccagtacagacgactcaagaggaagacgggtgc tcatgccgctttcctgaggaggaggaaggagggtgcgaactgcgcgttaagttctcccgatcagccg acgcgcctgcttacaagcagggccagaaccaactgtacaacgagctgaatctcggtagacgggaaga gtacgacgtgttggacaaacgagaggccgcgacccagaaatgggcggcaagcctcgcaggaaaaac ccccaggagggactgtacaatgagttgcagaaagataagatggcagaagcttatagcgagatcggaa tgaaggggaaaggagacgagggaaaggacacgacggcctttatcagggcctgtccacagcaacaaa agatacgtatgacgccctccatatgcaggcacttccaccacggtgataagtttaaacccgctgatca ggcggccgcgaaggatctgcgatcgctccggtgcccgtcag
```

CAR E6 FcH/8/4-1BB/CD3z sequence:
(DNA)

(SEQ ID NO: 315)
```
atggccctgcccgtgaccgctttgctgctcccccctggcgctgctgctgcacgccgccaggccagagg tccagctggttgagagtggcgtgggctggttaagcctggcggctccctgcggctgagctgcgccgc gagtggatttactttcagccgatatgggatgagttgggtgcggcaagctcccgggaagaggctggaa tgggtctcaacaatctccggggggggcacttacatctattacccccgactcagtcaaggggagattta ccatttcacgagacaacgctaagaatacccgtatttgcagatgaattctctgagagcagaggacac agctgtttactattgtacccgcgacaactatggcaggaactacgactacggtatggactattgggga caagggacattggttacagtgagcagtggcggcggggcagcggaggaggaggcagcggtggcggag gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaagcacctgaactc ctgggggaccgtcagtcttcctcttccccccaaaacccaaggacacccctcatgatctcccggaccc ctgaggtcacatgcgtggtggtggacgtgagccacgaagaccctgaggtcaagttcaactggtacgt ggacggcgtggaggtgcataatgccaagacaaagccgcgggaggagcagtacaacagcacgtaccgt gtggtcagcgtcctcaccgtcctgcaccaggactggctgaatggcaaggagtacaagtgcaaggtct ccaacaaagccctcccagcccccatcgagaaaaccatctccaaagccaaagggcagccccgagaacc acaggtgtacaccctgcccccatcccgggaggagatgaccaagaaccaggtcagcctgacctgcctg gtcaaaggcttctatcccagcgacatcgccgtggagtgggagagcaatgggcagccggagaacaact acaagaccacgcctcccgtgctggactccgacggctccttcttcctctacagcaagctcaccgtgga caagagcaggtggcagcaggggaacgtcttctcatgctccgtgatgcatgaggctctgcacaaccac tacacgcagaagagcctctccctgtctccgggtaaaatctacatttgggccccgctcgcaggcacat
```

-continued gtggagtgctcctcctctccctggtgattaccctgtactgcaaaaggggccgcaaaaaactccttta cattttaagcagccttttatgaggccagtacagacgactcaagaggaagacgggtgctcatgccgc tttcctgaggaggaggaaggagggtgcgaactgcgcgttaagttctcccgatcagccgacgcgcctg cttacaagcagggccagaaccaactgtacaacgagctgaatctcggtagacgggaagagtacgacgt gttggacaaacggagaggccgcgacccagaaatgggcggcaagcctcgcaggaaaaaccccaggag ggactgtacaatgagttgcagaaagataagatggcagaagcttatagcgagatcggaatgaaggggg aaaggagacgagggaaaggacacgacggcctttatcagggcctgtccacagcaacaaaagatacgta tgacgccctccatatgcaggcacttccaccacggtgataa (amino acids)
(SEQ ID NO: 316)

MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKAPEL

LGGPSVFLFPPKPKDTLMISRTPEVTCVVVDVSHEDPEVKFNWYVDGVEVHNAKTKPREEQYNSTYR

VVSVLTVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMHEALHNH

YTQKSLSLSPGKIYIWAPLAGTCGVLLLSLVITLYCKRGRKKLLYIFKQPFMRPVQTTQEEDGCSCR

FPEEEEGGCELRVKFSRSADAPAYKQGQNQLYNELNLGRREEYDVLDKRRGRDPEMGGKPRRKNPQE

GLYNELQKDKMAEAYSEIGMKGERRRGKGHDGLYQGLSTATKDTYDALHMQALPPR**

E6 CAR FcH pCDH gBLOCK sequence:
(DNA)
(SEQ ID NO: 317)
agtacctctaatctggcctcaggtatccctgcacgattttctggatctggttcaggttctgattaca ccctcactatctctagcctggagcctgaagactttgccgtttattactgccagcagaggtctagctc cccattcacctttgggagtgggaccaaggttgaaattaaagcacctgaactcctgggggaccgtca gtcttcctcttccccccaaaacccaaggacaccctcatgatctcccggacccctgaggtcacatgcg tggtggtggacgtgagccacgaagaccctgaggtcaagttcaactggtacgtggacggcgtggaggt gcataatgccaagacaaagccgcgggaggagcagtacaacagcacgtaccgtgtggtcagcgtcctc accgtcctgcaccaggactggctgaatggcaaggagtacaagtgcaaggtctccaacaaagcccccc cagcccccatcgagaaaaccatctccaaagccaaagggcagccccgagaaccacaggtgtacaccct gcccccatcccgggaggagatgaccaagaaccaggtcagcctgacctgcctggtcaaaggcttctat cccagcgacatcgccgtggagtgggagagcaatgggcagccggagaacaactacaagaccacgcctc ccgtgctg CAR E6 Fc/4/4-1BB/CD3z sequence:
(DNA)
(SEQ ID NO: 318)
atggccctgcccgtgaccgctttgctgctcccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccgggggggcacttacatctattaccccgactcagtcaaggggagattta ccatttcacgagacaacgctaagaatacccgtatttgcagatgaattctctgagagcagaggacac agctgtttactattgtacccgcgacaactatggcaggaactacgactacggtatggactattgggga caagggacattggttacagtgagcagtggcggcggggggcagcggaggaggaggcagcggtggcggag gcagcgagatagtgctcacgcagtcacccgcgactctcagtctctcacctggggaacgagctaccct -continued

```
gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaagagcccaatct tgtgacaaaactcacacatgcccaccgtgcccagcacctgaactcctggggggaccgtcagtcttcc tcttccccccaaaacccaaggacaccctcatgatctcccggacccctgaggtcacatgcgtggtggt ggacgtgagccacgaagaccctgaggtcaagttcaactggtacgtggacggcgtggaggtgcataat gccaagacaaagccgcgggaggagcagtacaacagcacgtaccgtgtggtcagcgtcctcaccgtcc tgcaccaggactggctgaatggcaaggagtacaagtgcaaggtctccaacaaagcccttcccagcccc atcgagaaaaccatctccaaagccaaagggcagccccgagaaccacaggtgtacaccctgcccccca tcccgggaggagatgaccaagaaccaggtcagcctgacctgcctggtcaaaggcttctatcccagcg acatcgccgtggagtgggagagcaatgggcagccggagaacaactacaagaccacgcctcccgtgct ggactccgacggctccttcttcctctacagcaagctcaccgtggacaagagcaggtggcagcagggg aacgtcttctcatgctccgtgatgcatgaggctctgcacaaccactacacgcagaagagcctctccc tgtctccgggtaaaatggccctgattgtgctgggggggcgtcgccggcctcctgcttttcattgggct aggcatcttcttcaaaaggggccgcaaaaaactcctttacatttttaagcagccttttatgaggcca gtacagacgactcaagaggaagacgggtgctcatgccgctttcctgaggaggaggaaggagggtgcg aactgcgcgttaagttctcccgatcagccgacgcgcctgcttacaagcagggccagaaccaactgta caacgagctgaatctcggtagacgggaagagtacgacgtgttggacaaacggagaggccgcgaccca gaaatgggcggcaagcctcgcaggaaaaaccccaggagggactgtacaatgagttgcagaaagata agatggcagaagcttatagcgagatcggaatgaagggggaaaggagacgagggaaaggacacgacgg cctttatcagggcctgtccacagcaacaaaagatacgtatgacgccctccatatgcaggcacttcca ccacggtgataa
```

(amino acids)

(SEQ ID NO: 319)

```
MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKEPKS

CDKTHTCPPCPAPELLGGPSVFLFPPKPKDTLMISRTPEVTCVVVDVSHEDPEVKFNWYVDGVEVHN

AKTKPREEQYNSTYRVVSVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGSFFLYSKLTVDKSRWQQG

NVFSCSVMHEALHNHYTQKSLSLSPGKMALIVLGGVAGLLLFIGLGIFFKRGRKKLLYIFKQPFMRP

VQTTQEEDGCSCRFPEEEEGGCELRVKFSRSADAPAYKQGQNQLYNELNLGRREEYDVLDKRRGRDP

EMGGKPRRKNPQEGLYNELQKDKMAEAYSEIGMKGERRRGKGHDGLYQGLSTATKDTYDALHMQALP

PR**
```

E6 CAR 44BB3 pCDH gBLOCK sequence:
(DNA)

(SEQ ID NO: 320)

```
agaacaactacaagaccacgcctcccgtgctggactccgacggctccttcttcctctacagcaagct caccgtggacaagagcaggtggcagcaggggaacgtcttctcatgctccgtgatgcatgaggctctg cacaaccactacacgcagaagagcctctcccctgtctccgggtaaaatggccctgattgtgctgggg gcgtcgccggcctcctgcttttcattgggctaggcatcttcttcaaaaggggccgcaaaaaactcct
```

-continued ttacattttaagcagccttttatgaggccagtacagacgactcaagaggaagacgggtgctcatgc cgctttcctgaggaggaggaaggagggtgcgaactgcgcgttaagttctcccgatcagccgacgcgc ctgcttacaagcagggccagaaccaactgtacaacgagctgaatctcggtagacgggaagagtacga cgtgttggacaaacggagaggccgcgacccagaaatgggcggcaagcctcgcaggaaaaaccccag gagggactgtacaatgagttgcagaaagataagatggcagaagcttatagcgagatcggaatgaagg gggaaggagacgagggaaaggacacgacggcctttatcagggcctgtccacagcaacaaaagatac gtatgacgccctccatatgcaggcacttccaccacggtgataagtttaaacccgctgatcaggcggc cgcgaaggatctgcgatcgctccggtgcccgtcag CAR E6 FcH/4/4-1BB/CD3z sequence:
(DNA)

(SEQ ID NO: 321)

atggccctgcccgtgaccgctttgctgctcccctggcgctgctgctgcacgccgccaggccagagg tccagctggttgagagtggcgtgggctggttaagcctggcggctccctgcggctgagctgcgccgc gagtggatttactttcagccgatatgggatgagttgggtgcggcaagctcccgggaagaggctggaa tgggtctcaacaatctccgggggggcacttacatctattaccccgactcagtcaaggggagattta ccatttcacgagacaacgctaagaatacccgtatttgcagatgaattctctgagagcagaggacac agctgtttactattgtacccgcgacaactatggcaggaactacgactacggtatggactattggga caagggacattggttacagtgagcagtggcggcggggcagcggaggaggaggcagcggtggcggag gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaagcacctgaactc ctgggggaccgtcagtcttcctcttccccccaaaacccaaggacaccctcatgatctcccggaccc ctgaggtcacatgcgtggtggtggacgtgagccacgaagaccctgaggtcaagttcaactggtacgt ggacggcgtggaggtgcataatgccaagacaaagccgcgggaggagcagtacaacagcacgtaccgt gtggtcagcgtcctcaccgtcctgcaccaggactggctgaatggcaaggagtacaagtgcaaggtct ccaacaaagccctcccagcccccatcgagaaaaccatctccaaagccaaagggcagccccgagaacc acaggtgtacaccctgcccccatcccgggaggagatgaccaagaaccaggtcagcctgacctgcctg gtcaaaggcttctatcccagcgacatcgccgtggagtgggagagcaatgggcagccggagaacaact acaagaccacgcctcccgtgctggactccgacggctccttcttcctctacagcaagctcaccgtgga caagagcaggtggcagcaggggaacgtcttctcatgctccgtgatgcatgaggctctgcacaaccac tacacgcagaagagcctctccctgtctccgggtaaaatggccctgattgtgctggggggcgtcgccg gcctcctgcttttcattgggctagcatcttcttcaaaagggggccgcaaaaaaactcctttacatttt taagcagccttttatgaggccagtacagacgactcaagaggaagacgggtgctcatgccgctttcct gaggaggaggaaggagggtgcgaactgcgcgttaagttctcccgatcagccgacgcgcctgcttaca agcagggccagaaccaactgtacaacgagctgaatctcggtagacgggaagagtacgacgtgttgga caaacggagaggccgcgacccagaaatgggcggcaagcctcgcaggaaaaaccccaggagggactg tacaatgagttgcagaaagataagatggcagaagcttatagcgagatcggaatgaaggggggaaagga gacgagggaaaggacacgacggcctttatcagggcctgtccacagcaacaaaagatacgtatgacgc cctccatatgcaggcacttccaccacggtgataa (amino acids)

(SEQ ID NO: 322)

MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKAPEL

LGGPSVFLFPPKPKDTLMISRTPEVTCVVVDVSHEDPEVKFNWYVDGVEVHNAKTKPREEQYNSTYR

VVSVLTVLHQDWLNGKEYKCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRWQQGNVFSCSVMHEALHNH

YTQKSLSLSPGKMALIVLGGVAGLLLFIGLGIFFKRGRKKLLYIFKQPFMRPVQTTQEEDGCSCRFP

EEEEGGCELRVKFSRSADAPAYKQGQNQLYNELNLGRREEYDVLDKRRGRDPEMGGKPRRKNPQEGL

YNELQKDKMAEAYSEIGMKGERRRGKGHDGLYQGLSTATKDTYDALHMQALPPR**

CAR E6 IgD/8/4-1BB/CD3z sequence:
(DNA)

(SEQ ID NO: 323)

atggccctgccgtgaccgctttgctgctcccctggcgctgctgctgcacgccgccaggccagaggtccagc tggttgagagtggcggtgggctggttaagcctggcggctccctgcgcgctgagctgcgccgcgagtggatttac tttcagccgatatgggatgagttgggtgcggcaagctcccgggaagaggctggaatgggtctcaacaatctcc ggggggggcacttacatctattaccccgactcagtcaaggggagatttaccatttcacgagacaacgctaaga atacccctgtatttgcagatgaattctctgagagcagaggacacagctgtttactattgtacccgcgacaacta tggcaggaactacgactacggtatggactattggggacaaggacattggttacagtgagcagtggcggcggg ggcagcggaggaggaggcagcggtggcggaggcagcgagatagtgctcacgcagtcacccgcgactctcagtc tctcacctggggaacgagctaccctgacgtgctctgctacctcctcagtgtcatatattcactggtatcagca acggcccgggcagtcccctagattgctcatttatagtacctctaatctggcctcaggtatccctgcacgattt tctggatctggttcaggttctgattacacccctcactatctctagcctggagcctgaagactttgccgttatt actgccagcagaggtctagctccccattcacctttgggagtgggaccaaggttgaaattaaagagtctccaaa ggcacaggcctcctcagtgcccactgcacaaccccaagcagagggcagcctcgccaaggcaaccacagcccca gccaccacccgtaacacaggaagaggcggcgaagagaagaaaaaggagaaggagaaagaggaacaagaagaga gagagacaaagacaccaatctacatttgggccccgctcgcaggcacatgtggagtgctcctcctctccctggt gattaccctgtactgcaaaaggggccgcaaaaaactcctttacattttttaagcagccttttatgaggccagta cagacgactcaagaggaagacgggtgctcatgccgctttcctgaggaggaggaaggagggtgcgaactgcgcg ttaagttctcccgatcagccgacgcgcctgcttacaagcagggccagaaccaactgtacaacgagctgaatct cggtagacgggaagagtacgacgtgttggacaaacgagaggccgcgacccagaaatgggcggcaagcctcgc aggaaaaaccccaggagggactgtacaatgagttgcagaaagataagatggcagaagcttatagcgagatcg gaatgaaggggaaggagacgagggaaggacacgacggcctttatcagggcctgtccacagcaacaaaaga tacgtatgacgccctccatatgcaggcacttccaccacggtgataa (amino acids)

(SEQ ID NO: 324)

MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKESPK

AQASSVPTAQPQAEGSLAKATTAPATTRNTGRGGEEKKKEKEKEEQEERETKTPIYIWAPLAGTCGV

LLLSLVITLYCKRGRKKLLYIFKQPFMRPVQTTQEEDGCSCRFPEEEEGGCELRVKFSRSADAPAYK

QGQNQLYNELNLGRREEYDVLDKRRGRDPEMGGKPRRKNPQEGLYNELQKDKMAEAYSEIGMKGERR

RGKGHDGLYQGLSTATKDTYDALHMQALPPR**

E6 CAR IgD8 pcDH gBLOCK sequence:
(DNA)

(SEQ ID NO: 325)

agtacctctaatctggcctcaggtatccctgcacgattttctggatctggttcaggttctgattaca ccctcactatctctagcctggagcctgaagactttgccgtttattactgccagcagaggtctagctc cccattcacctttgggagtgggaccaaggttgaaattaaagagtctccaaaggcacaggcctcctca gtgcccactgcacaaccccaagcgagggcagcctcgccaaggcaaccacgcccagccaccacc gtaacacaggaagaggcggcgaagagaagaaaaggagaaggagaaagaggaacaagaagagagaga gacaaagacaccaatctacatttgggccccgctcgcaggcacatgtggagtgctcctcctctccctg gtgattaccctgtactgcaaaaggggccgcaaaaaactcctttacattttttaagcagccttttatga ggccag E6 CAR BB 3 pCDH gBLOCK sequence:
(DNA)

(SEQ ID NO: 326)

acatttttaagcagccttttatgaggccagtacagacgactcaagaggaagacgggtgctcatgccg ctttcctgaggaggaggaaggagggtgcgaactgcgcgttaagttctcccgatcagccgacgcgcct gcttacaagcagggccagaaccaactgtacaacgagctgaatctcggtagacgggaagagtacgacg tgttggacaaacggagaggccgcgacccagaaatgggcggcaagcctcgcaggaaaaaccccagga gggactgtacaatgagttgcagaaagataagatggcagaagcttatagcgagatcggaatgaagggg gaaaggagacgagggaaaggacacgacggcctttatcagggcctgtccacagcaacaaaagatacgt atgacgccctccatatgcaggcacttccaccacggtgataagtttaaacccgctgatcaggcggccg cgaaggatctgcgatcgctccggtgcccgtcag CAR E6 IgD/4/4-1BB/CD3z sequence:
(DNA)

(SEQ ID NO: 327)

atggccctgcccgtgaccgctttgctgctcccccctggcgctgctgctgcacgccgccaggccagagg tccagctggttgagagtggcggtgggctggttaagcctggcggctccctgcggctgagctgcgccgc gagtggatttacttttcagccgatatgggatgagttgggtgcggcaagctcccgggaagaggctggaa tgggtctcaacaatctccggggggggcacttacatctattacccccgactcagtcaaggggagattta ccatttcacgagacaacgctaagaatacccctgtatttgcagatgaattctctgagagcagaggacac agctgtttactattgtacccgcgacaactatggcaggaactacgactacggtatggactattgggga caagggacattggttacagtgagcagtggcggcggggcagcggaggaggaggcagcggtggcggag gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaagagtctccaaag gcacaggcctcctcagtgcccactgcacaaccccaagcagagggcagcctcgccaaggcaaccacag ccccagccaccacccgtaacacaggaagaggcggcgaagagaagaaaaggagaaggagaaagagga acaagaagagagagagacaaagacaccaatggccctgattgtgctggggggcgtcgccggcctcctg cttttcattgggctaggcatcttcttcaaaggggccgcaaaaaactcctttacattttttaagcagc cttttatgaggccagtacagacgactcaagaggaagacgggtgctcatgccgctttcctgaggagga ggaaggagggtgcgaactgcgcgttaagttctcccgatcagccgacgcgcctgcttacaagcagggc -continued cagaaccaactgtacaacgagctgaatctcggtagacgggaagagtacgacgtgttggacaaacgga gaggccgcgacccagaaatgggcggcaagcctcgcaggaaaaaccccaggagggactgtacaatga gttgcagaaagataagatggcagaagcttatagcgagatcggaatgaaggggaaggagacgaggg aaaggacacgacggccttatcagggcctgtccacagcaacaaaagatacgtatgacgccctccata tgcaggcacttccaccacggtgataa (amino acids)

(SEQ ID NO: 328)

MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKESPK

AQASSVPTAQPQAEGSLAKATTAPATTRNTGRGGEEKKKEKEKEEQEERETKTPMALIVLGGVAGLL

LFIGLGIFFKRGRKKLLYIFKQPFMRPVQTTQEEDGCSCRFPEEEEGGCELRVKFSRSADAPAYKQG

QNQLYNELNLGRREEYDVLDKRRGRDPEMGGKPRRKNPQEGLYNELQKDKMAEAYSEIGMKGERRRG

KGHDGLYQGLSTATKDTYDALHMQALPPR**

E6 CAR IgD4 pcDH gBLOCK sequence:
(DNA)

(SEQ ID NO: 329)

agtacctctaatctggcctcaggtatccctgcacgattttctggatctggttcaggttctgattaca ccctcactatctctagcctggagcctgaagactttgccgtttattactgccagcagaggtctagctc cccattcacctttggagtgggaccaaggttgaaattaaagagtctccaaaggcacaggcctcctca gtgcccactgcacaaccccaagcagagggcagcctcgccaaggcaaccacagcccagccaccaccc gtaacacaggaagaggcggcgaagagaagaaaaaggagaaggagaaagaggaacaagaagagagaga gacaaagacaccaatggccctgattgtgctggggggcgtcgccggcctcctgcttttcattgggcta ggcatcttcttcaaaggggccgcaaaaaactcctttacattttaagcagcctttatgaggccag CAR E6 X4/8/4-1BB/CD3z sequence:
(DNA)

(SEQ ID NO: 330)

atggccctgcccgtgaccgctttgctgctccccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccgggggggcacttacatctattaccccgactcagtcaaggggagattta ccatttcacgagacaacgctaagaataccctgtatttgcagatgaattctctgagagcagaggacac agctgtttactattgtacccgcgacaactatggcaggaactacgactacggtatggactattggga caagggacattggttacagtgagcagtggcggcggggcagcggaggaggaggcagcggtggcggag gcagcgagatagtgctcacgcagtcacccgcgactctcagtctctcacctggggaacgagctaccct gacgtgctctgctacctcctcagtgtcatatattcactggtatcagcaacgcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctcccccattcacctttggagtgggaccaaggttgaaattaaagacaagacgcac accaagccacctaaaccagctccagaactgctcggaggtcctggcaccggaaccggaggacctacca tcaaaccacctaagccacctaagcctgctcctaacctgctcggaggacctatctacatttgggcccc gctcgcaggcacatgtggagtgctcctcctctccctggtgattaccctgtactgcaaaaggggccgc aaaaaactcctttacattttaagcagcctttatgaggccagtacagacgactcaagaggaagacg -continued ggtgctcatgccgcttcctgaggaggaggaaggagggtgcgaactgcgcgttaagttctcccgatc agccgacgcgcctgcttacaagcagggccagaaccaactgtacaacgagctgaatctcggtagacgg gaagagtacgacgtgttggacaaacggagaggccgcgacccagaaatgggcggcaagcctcgcagga aaaaccccaggagggactgtacaatgagttgcagaaagataagatggcagaagcttatagcgagat cggaatgaaggggggaaggagacgagggaaaggacacgacggcctttatcagggcctgtccacagca acaaaagatacgtatgacgccctccatatgcaggcacttccaccacggtgataa (amino acids)

(SEQ ID NO: 331)
MALPVTALLLPLALLLHAARPEVQLVESGGGLVKPGGSLRLSCAASGFTFSRYGMSWVRQAPGKRLE
WVSTISGGGTYIYYPDSVKGRFTISRDNAKNTLYLQMNSLRAEDTAVYYCTRDNYGRNYDYGMDYWG
QGTLVTVSSGGGGSGGGGSGGGGSEIVLTQSPATLSLSPGERATLTCSATSSVSYIHWYQQRPGQSP
RLLIYSTSNLASGIPARFSGSGSGSDYTLTISSLEPEDFAVYYCQQRSSSPFTFGSGTKVEIKDKTH
TKPPKPAPELLGGPGTGTGGPTIKPPKPPKPAPNLLGGPIYIWAPLAGTCGVLLLSLVITLYCKRGR
KKLLYIFKQPFMRPVQTTQEEDGCSCRFPEEEEGGCELRVKFSRSADAPAYKQGQNQLYNELNLGRR
EEYDVLDKRRGRDPEMGGKPRRKNPQEGLYNELQKDKMAEAYSEIGMKGERRRGKGHDGLYQGLSTA
TKDTYDALHMQALPPR**

E6 CAR X48 pCDH gBLOCK sequence:
(DNA)

(SEQ ID NO: 332)
agtacctctaatctggcctcaggtatccctgcacgattttctggatctggttcaggttctgattaca ccctcactatctctagcctggagcctgaagactttgccgtttattactgccagcagaggtctagctc cccattcacctttggagtgggaccaaggttgaaattaaagacaagacgcacaccaagccacctaaa ccagctccagaactgctcggaggtcctggcaccggaaccggaggacctaccatcaaaccacctaagc cacctaagcctgctcctaacctgctcggaggacctatctacatttgggccccgctcgcaggcacatg tggagtgctcctcctccctggtgattaccctgtactgcaaaagggggccgcaaaaaactccttttac attttttaagcagccttttatgaggccag CAR E6 X4/4-1BB/CD3z sequence:
(DNA)

(SEQ ID NO: 333)
atggccctgccgtgaccgctttgctgctcccctggcgctgctgctgcacgccgccaggccagagg tccagctggttgagagtggcggtgggctggttaagcctggcggctccctgcggctgagctgcgccgc gagtggatttacttcagccgatatgggatgagttgggtgcggcaagctcccgggaagaggctggaa tgggtctcaacaatctccgggggggcacttacatctattccccgactcagtcaaggggagattta ccatttcacgagacaacgctaagaatacctgtatttgcagatgaattctctgagagcagaggacac agctgtttactattgtacccgcgacaactatggcaggaactacgactacggtatggactattggga caagggacattggttacagtgagcagtggcggcggggggcagcggaggaggaggcagcggtggcggag gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaagacaagacgcac accaagccacctaaaccagctccagaactgctcggaggtcctggcaccggaaccggaggacctacca tcaaaccacctaagccacctaagcctgctcctaacctgctcggaggacctatggccctgattgtgct ggggggcgtcgccggcctcctgctttcattgggctaggcatcttcttcaaaaggggccgcaaaaaa ctccttttacatttttaagcagccttttatgaggccagtacagacgactcaagaggaagacgggtgct -continued catgccgctttcctgaggaggaggaaggagggtgcgaactgcgcgttaagttctcccgatcagccga cgcgcctgcttacaagcagggccagaaccaactgtacaacgagctgaatctcggtagacgggaagag tacgacgtgttggacaaacggagaggccgcgacccagaaatgggcggcaagcctcgcaggaaaaacc cccaggagggactgtacaatgagttgcagaaagataagatggcagaagcttatagcgagatcggaat gaaggggggaaggagacgagggaaaggacacgacggcctttatcagggcctgtccacagcaacaaaa gatacgtatgacgccctccatatgcaggcacttccaccacggtgataa (amino acids)
(SEQ ID NO: 334)
MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKDKTH

TKPPKPAPELLGGPGTGTGGPTIKPPKPPKPAPNLLGGPMALIVLGGVAGLLLFIGLGIFFKRGRKK

LLYIFKQPFMRPVQTTQEEDGCSCRFPEEEEGGCELRVKFSRSADAPAYKQGQNQLYNELNLGRREE

YDVLDKRRGRDPEMGGKPRRKNPQEGLYNELQKDKMAEAYSEIGMKGERRRGKGHDGLYQGLSTATK

DTYDALHMQALPPR**

E6 CAR X44 pCDH gBLOCK sequence:
(DNA)
(SEQ ID NO: 335)
agtacctctaatctggcctcaggtatccctgcacgattttctggatctggttcaggttctgattaca ccctcactatctctagcctggagcctgaagactttgccgtttattactgccagcagaggtctagctc cccattcacctttggagtgggaccaaggttgaaattaaagacaagacgcacaccaagccacctaaa ccagctccagaactgctcggaggtcctggcaccggaaccggaggacctaccatcaaaccacctaagc cacctaagcctgctcctaacctgctcggaggacctatggccctgattgtgctggggggcgtcgccgg cctcctgcttttcattgggctaggcatcttcttcaaaagggggccgcaaaaaactcctttacattttt aagcagccttttatgaggccag CAR E6 8 + 4/4/4-1BB/CD3z sequence:
(DNA)
(SEQ ID NO: 336)
atggccctgcccgtgaccgctttgctgctcccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccgggggggggcacttacatctattaccccgactcagtcaaggggagattta ccatttcacgagacaacgctaagaataccctgtatttgcagatgaattctctgagagcagaggacac agctgtttactattgtacccgcgacaactatggcaggaactacgactacggtatggactattgggga caagggacattggttacagtgagcagtggcggcggggggcagcggaggaggaggcagcggtggcggag gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcattttatagtacctctaatctggcctcaggtatccctgcacgattttctggatctggtt caggttctgattacaccctcactatctctagcctggagcctgaagactttgccgtttattactgcca gcagaggtctagctcccccattcacctttggagtgggaccaaggttgaaattaaaacgacaaccccg gcccccagaccaccaacgccagcccccaccatcgccagccaacccctgtctctgagaccagaagcct gtaggcctgccgccggtggagctgtgcacacaagaggactggatttcgcctgtgatatggccctgat tgtgctgggggggcgtcgccggcctcctgcttttcattgggctaggcatcttcttcaaaagggggccgc

```
aaaaaactcctttacattttttaagcagccttttatgaggccagtacagacgactcaagaggaagacg ggtgctcatgccgcttctgaggaggaggaaggagggtgcgaactgcgcgttaagttctcccgatc agccgacgcgcctgcttacaagcagggccagaaccaactgtacaacgagctgaatctcggtagacgg gaagagtacgacgtgttggacaaacgagaggccgcgacccagaaatgggcggcaagcctcgcagga aaaaccccaggagggactgtacaatgagttgcagaaagataagatggcagaagcttatagcgagat cggaatgaaggggaaggagacgagggaaaggacacgacggcctttatcagggcctgtccacagca acaaaagatacgtatgacgccctccatatgcaggcacttccaccacggtgataa
```

(amino acids)
(SEQ ID NO: 337)

MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKTTTP

APRPPTPAPTIASQPLSLRPEACRPAAGGAVHTRGLDFACDMALIVLGGVAGLLLFIGLGIFFKRGR

KKLLYIFKQPFMRPVQTTQEEDGCSCRFPEEEEGGCELRVKFSRSADAPAYKQGQNQLYNELNLGRR

EEYDVLDKRRGRDPEMGGKPRRKNPQEGLYNELQKDKMAEAYSEIGMKGERRRGKGHDGLYQGLSTA

TKDTYDALHMQALPPR**

E6 CAR CD844 pCDH gBLOCK sequence:
(DNA)
(SEQ ID NO: 338)
```
agtacctctaatctggcctcaggtatccctgcacgattttctggatctggttcaggttctgattaca ccctcactatctctagcctggagcctgaagactttgccgtttattactgccagcagaggtctagctc cccattcacctttgggagtgggaccaaggttgaaattaaaacgacaaccccggcccccagaccacca acgccagcccccaccatcgccagccaaccctgtctctgagaccagaagcctgtaggcctgccgccg gtggagctgtgcacacaagaggactggatttcgcctgtgatatggccctgattgtgctggggggcgt cgccggcctcctgcttttcattgggctaggcatcttcttcaaaaggggccgcaaaaaactcctttac attttttaagcagccttttatgaggccag
```

Humanized C2 scFV sequence in CAR:
(DNA)
(SEQ ID NO: 339)
```
gagggccaccatggccttgccagtgacggccctgctgctgccattggctcttctgttgcacgctgccaggcct gaagtgcagctcgtagagagtggcggggactggtgaagcccggtggaagcctcagactcagttgcgccgcct caggtttcacttttcaggttacgccatgtcctgggtaagacaggcaccggggaaaggactcgagtgggtgtc tactatcagctcaggaggcacttatatatattatcctgactctgtaaaaggccgatttacgatttctcgcgac aatgcaaagaactccctctacctccaaatgaacagtcttagggcagaagacactgctgtatactattgtgcac gcctcggcggcgacaactactacgagtactttgacgtgtggggaaagggactaccgtgacagtttcaagcgg aggaggtggctcaggtggaggcggtcagggggggaggaagtgatattgtgctcacacaatccccagcctcc ctggctgtgtctcccggccaacgcgctacaattacatgtcgggcctccaaaagcgtgagcaccagcggctaca gctacatgcactggtatcaacagaaaccaggacaaccccccaaactgttgatttatctcgcttcaaacttgga gtccggcgtgcctgcgcgcttttcaggagtgggagcggcacagattttacgctgactatcaaccccgtagaa gcaaacgatacagcgaattattattgtcaacattcccgggaactccctttacgttcggcggggggcacaaagg tcgaaattaagagaacc
```

(amino acids)
(SEQ ID NO: 340)
EVQLVESGGGLVKPGGSLRLSCAASGFTFSGYAMSWVRQAPGKGLEWVSTISSGGTYIYYPDSVKGR

FTISRDNAKNSLYLQMNSLRAEDTAVYYCARLGGDNYYEYFDVWGKGTTVTVSSGGGGSGGGGSGGG

GSDIVLTQSPASLAVSPGQRATITCRASKSVSTSGYSYMHWYQQKPGQPPKLLIYLASNLESGVPAR

FSGSGSGTDFTLTINPVEANDTANYYCQHSRELPFTFGGGTKVEIKRT

Humanized E6 scFV sequence in CAR:
(DNA)
(SEQ ID NO: 341)
gaggtccagctggttgagagtggcggtgggctggttaagcctggcggctccctgcggctgagctgcg ccgcgagtggatttactttcagccgatatgggatgagttgggtgcggcaagctcccgggaagaggct ggaatgggtctcaacaatctccggggggggcacttacatctattaccccgactcagtcaaggggaga tttaccatttcacgagacaacgctaagaatacctgtatttgcagatgaattctctgagagcagagg acacagctgtttactattgtacccgcgacaactatggcaggaactacgactacggtatggactattg gggacaagggacattggttacagtgagcagtggcggcgggggcagcggaggaggaggcagcggtggg ggggcagcgagatagtgctcacgcagtcacccgcgactctcagtctctcacctggggaacgagcta ccctgacgtgctctgctacctcctcagtgtcatatattcactggtatcagcaacggcccgggcagtc ccctagattgctcatttatagtacctctaatctggcctcaggtatccctgcacgattttctggatct ggttcaggttctgattacacctcactatctctagcctggagcctgaagacttttgccgtttattact gccagcagaggtctagctcccattcacctttgggagtgggaccaaggttgaaattaaa (amino acids)
(SEQ ID NO: 342)
EVQLVESGGGLVKPGGSLRLSCAASGFTFSRYGMSWVRQAPGKRLEWVSTISGGGTYIYYPDSVKGR

FTISRDNAKNTLYLQMNSLRAEDTAVYYCTRDNYGRNYDYGMDYWGQGTLVTVSSGGGGSGGGGSGG

GGSEIVLTQSPATLSLSPGERATLTCSATSSVSYIHWYQQRPGQSPRLLIYSTSNLASGIPARFSGS

GSGSDYTLTISSLEPEDFAVYYCQQRSSSPFTFGSGTKVEIK

CD8 leader sequence:
(DNA)
(SEQ ID NO: 343)
atggccctgcccgtgaccgctttgctgctccccctggcgctgctgctgcacgccgccaggcca (amino acids)
(SEQ ID NO: 344)
MALPVTALLLPLALLLHAARP CD8 hinge domain sequence:
(DNA)
(SEQ ID NO: 345)
acgacaaccccggcccccagaccaccaacgccagcccccaccatcgccagccaacccctgtctctga
gaccagaagcctgtaggcctgccgccggtggagctgtgcacacaagaggactggatttcgcctgtga
t (amino acids)
(SEQ ID NO: 346)
TTTPAPRPPTPAPTIASQPLSLRPEACRPAAGGAVHTRGLDFACD CD4 hinge domain sequence:
(DNA)
(SEQ ID NO: 347)
tcgggacaggtcctgctggaatccaacatcaaggttctgcccacatggtccacccggtgcagcca (amino acids)
(SEQ ID NO: 348)
SGQVLLESNIKVLPTWSTPVQP CD28 hinge domain sequence:
(DNA)
(SEQ ID NO: 349)
aaacacctttgtccaagtcccctatttcccggaccttctaagccc (amino acids)
(SEQ ID NO: 350)
KHLCPSPLFPGPSKP CD8 + CD4 hinge domain sequence:
(DNA)
(SEQ ID NO: 351)
acgacaaccccggcccccagaccaccaacgccagcccccaccatcgccagccaaccccctgtctctga
gaccagaagcctgtaggcctgccgccggtggagctgtgcacacaagaggactggatttcgcctgtga
ttcgggacaggtcctgctggaatccaacatcaaggttctgcccacatggtccaccccggtgcagcca (amino acids)
(SEQ ID NO: 352)
TTTPAPRPPTPAPTIASQPLSLRPEACRPAAGGAVHTRGLDFACDSGQVLLESNIKVLPTWSTPVQP CD8 + CD28 hinge domain sequence:
(DNA)
(SEQ ID NO: 353)
acgacaaccccggcccccagaccaccaacgccagcccccaccatcgccagccaaccccctgtctctga
gaccagaagcctgtaggcctgccgccggtggagctgtgcacacaagaggactggatttcgcctgtga
taaacacctttgtccaagtcccctatttcccggaccttctaagccc (amino acids)
(SEQ ID NO: 354)
TTTPAPRPPTPAPTIASQPLSLRPEACRPAAGGAVHTRGLDFACDKHLCPSPLFPGPSKP CD28 + CD4 hinge domain sequence:
(DNA)
(SEQ ID NO: 355)
aaacacctttgtccaagtcccctatttcccggaccttctaagccctcgggacaggtcctgctggaat
ccaacatcaaggttctgcccacatggtccaccccggtgcagcca (amino acids)
(SEQ ID NO: 356)
KHLCPSPLFPGPSKPSGQVLLESNIKVLPTWSTPVQP Human IgD hinge domain sequence:
(DNA)
(SEQ ID NO: 357)
gagtctccaaaggcacaggcctcctcagtgcccactgcacaaccccaagcagagggcagcctcgcca
aggcaaccacagcccccagccaccacccgtaacacaggaagaggcggcgaagagaagaaaaggagaa
ggagaaagaggaacaagaagagagagagacaaagacacca (amino acids)
(SEQ ID NO: 358)
ESPKAQASSVPTAQPQAEGSLAKATTAPATTRNTGRGGEEKKKEKEKEEQEERETKTP X4 linker (IgG1 and IgG2 modified hinge region) sequence:
(DNA)
(SEQ ID NO: 359)
gacaagacgcacaccaagccacctaaaccagctccagaactgctcggaggtcctggcaccggaaccg
gaggacctaccatcaaaccacctaagccacctaagcctgctcctaacctgctcggaggacct (amino acids)
(SEQ ID NO: 360)
DKTHTKPPKPAPELLGGPGTGTGGPTIKPPKPPKPAPNLLGGP CD3 zeta transmembrane domain sequence:
(DNA)
(SEQ ID NO: 361)
ctctgctacctgctggatggaatcctcttcatctatggtgtcattctcactgccttgttcctg (amino acids)
(SEQ ID NO: 362)
LCYLLDGILFIYGVILTALFL CD8 transmembrane domain sequence:
(DNA)
(SEQ ID NO: 363)
atctacatttgggccccgctcgcaggcacatgtggagtgctcctcctctccctggtgattaccctgt
actgc (amino acids)
(SEQ ID NO: 364)
IYIWAPLAGTCGVLLLSLVITLYC CD4 transmembrane domain sequence:
(DNA)
(SEQ ID NO: 365)
atggcccctgattgtgctgggggggcgtcgccggcctcctgcttttcattgggctaggcatcttcttc (amino acids)
(SEQ ID NO: 366)
MALIVLGGVAGLLLFIGLGIFF CD28 transmembrane domain sequence:
(DNA)
(SEQ ID NO: 367)
ttttgggtgctggtggtggttggtggagtcctggcttgctatagcttgctagtaacagtggcctttattattttctgggtg (amino acids)
(SEQ ID NO: 368)
FWVLVVVGGVLACYSLLVTVAFIIFWV 4-1BB transmembrane domain sequence:
(DNA)
(SEQ ID NO: 369)
atcatctccttctttcttgcgctgacgtcgactgcgttgctcttcctgctgttcttcctcacgctccgtttctctgttgtt (amino acids)
(SEQ ID NO: 370)
IISFFLALTSTALLFLLFFLTLRFSVV OX40 transmembrane domain sequence:
(DNA)
(SEQ ID NO: 371)
gttgccgccatcctgggcctgggcctggtgctggggctgctgggcccctggccatcctgctggccctgtacctgctc (amino acids)
(SEQ ID NO: 372)
VAAILGLGLVLGLLGPLAILLALYLL CD3 zeta domain sequence:
(DNA)
(SEQ ID NO: 373)
cgcgttaagttctcccgatcagccgacgcgcctgcttacaagcagggccagaaccaactgtacaacg agctgaatctcggtagacgggaagagtacgacgtgttggacaaacgagaggccgcgacccagaaat gggcggcaagcctcgcaggaaaaaccccaggagggactgtacaatgagttgcagaaagataagatg gcagaagcttatagcgagatcggaatgaaggggaaggagacgagggaaaggacacgacggcctttt atcagggcctgtccacagcaacaaaagatacgtatgacgccctccatatgcaggcacttccaccacg g (amino acids)
(SEQ ID NO: 374)
RVKFSRSADAPAYKQGQNQLYNELNLGRREEYDVLDKRRGRDPEMGGKPRRKNPQEGLYNELQKDKM
AEAYSEIGMKGERRRGKGHDGLYQGLSTATKDTYDALHMQALPPR CD3 zeta domain variant sequence:
(DNA)
(SEQ ID NO: 375)
agagtgaagttcagcaggagcgcagacgcccccgcgtaccagcagggccagaaccagctctataacg agctcaatctaggacgaagagaggagtacgatgttttggacaagagacgtggccgggaccctgagat ggggggaaagccgagaaggaagaaccctcaggaaggcctgtacaatgaactgcagaaagataagatg gcggaggcctacagtgagattgggatgaaaggcgagcgccggaggggcaaggggcacgatggcctttt accagggtctcagtacagccaccaaggacacctacgacgcccttcacatgcaggccctgccccctcg c (amino acids)
(SEQ ID NO: 376)
RVKFSRSADAPAYQQGQNQLYNELNLGRREEYDVLDKRRGRDPEMGGKPRRKNPQEGLYNELQKDKM
AEAYSEIGMKGERRRGKGHDGLYQGLSTATKDTYDALHMQALPPR CD28 domain sequence:
(DNA)
(SEQ ID NO: 377)
agaagcaagcggtctcggctcctgcattctgattacatgaacatgacccccaagaagaccaggccccaccaggaaacattaccagccctacgctccgccacgcgacttcgctgcctaccggtcc (amino acids)
(SEQ ID NO: 378)
RSKRSRLLHSDYMNMTPRRPGPTRKHYQPYAPPRDFAAYRS -continued 4-1BB domain sequence:
(DNA)
(SEQ ID NO: 379)
aaaaggggccgcaaaaaactcctttacattttttaagcagccttttatgaggccagtacagacgactc
aagaggaagacgggtgctcatgccgctttcctgaggaggaggaaggagggtgcgaactg (amino acids)
(SEQ ID NO: 380)
KRGRKKLLYIFKQPFMRPVQTTQEEDGCSCRFPEEEEGGCEL OX40 domain sequence:
(DNA)
(SEQ ID NO: 381)
cggagggaccagaggctgcccccccgatgcccacaagcccoctggggggaggcagtttccggaccccca
tccaagaggagcaggccgacgcccactccaccctggccaagatc (amino acids)
(SEQ ID NO: 382)
RRDQRLPPDAHKPPGGGSFRTPIQEEQADAHSTLAKI Humanized anti CD3 scFV clone 12F6 (VH-VL) sequence:
(DNA)
(SEQ ID NO: 383)
caggtgcagctggtgcagagcggaggtggagtggtccaacctggaagatctctgagactgagctgta aggctagcgggtacacgttcacatcttacacgatgcactgggtgaggcaagcccccggtaagggcct ggaatggatcggatatataaaccccagctcagggtataccaaatataatcagaagttcaaagatcgg ttcacgatttctgctgataaaagtaagtccaccgctttcctgcagatggactcactcaggccagaag atactggtgttatttctgtgcaaggtggcaggactacgacgtgtactttgactattgggggcaggg gacgcctgtaacagtatcaagcggcggtggcggatccggcggtggcggatccggcggtggcggatcc gatattcagatgacccagagcccgagcagcctgagcgcgagcgtgggcgatcgcgtgaccatgacct gccgcgcgagcagcagcgtgagctatatgcattggtatcagcagacccccgggcaaagcgccgaaacc gtggatttatgcgaccagcaacctggcgagcggcgtgccgagccgctttagcggcagcggcagcggc accgattataccctgaccattagcagcctgcagccggaagatattgcgacctattattgccagcagt ggagcagcaacccgccgacctttggccagggcaccaaactgcagattacccgc (amino acids)
(SEQ ID NO: 384)
QVQLVQSGGGVVQPGRSLRLSCKASGYTFTSYTMHWVRQAPGKGLEWIGYINPSSGYTKYNQKFKDR

FTISADKSKSTAFLQMDSLRPEDTGVYFCARWQDYDVYFDYWGQGTPVTVSSGGGGSGGGGSGGGGS

DIQMTQSPSSLSASVGDRVTMTCRASSSVSYMHWYQQTPGKAPKPWIYATSNLASGVPSRFSGSGSG

TDYTLTISSLQPEDIATYYCQQWSSNPPTFGQGTKLQITR

Humanized anti CD3 scFV clone 12F6 (VL-VH) sequence:
(DNA)
(SEQ ID NO: 385)
gatattcagatgacccagagcccgagcagcctgagcgcgagcgtgggcgatcgcgtgaccatgacct gccgcgcgagcagcagcgtgagctatatgcattggtatcagcagacccccgggcaaagcgccgaaacc gtggatttatgcgaccagcaacctggcgagcggcgtgccgagccgctttagcggcagcggcagcggc accgattataccctgaccattagcagcctgcagccggaagatattgcgacctattattgccagcagt ggagcagcaacccgccgacctttggccagggcaccaaactgcagattacccgcggcggtggcggatc cggcggtggcggatccggcggtggcggatcccaggtgcagctggtgcagagcggaggtggagtggtc caacctggaagatctctgagactgagctgtaaggctagcgggtacacgttcacatcttacacgatgc actgggtgaggcaagcccccggtaagggcctggaatggatcggatatataaaccccagctcagggta taccaaatataatcagaagttcaaagatcggttcacgatttctgctgataaaagtaagtccaccgct ttcctgcagatggactcactcaggccagaagatactggtgttatttctgtgcaaggtggcaggact acgacgtgtactttgactattgggggcaggggacgcctgtaacagtatcaagc (amino acids)

(SEQ ID NO: 386)
DIQMTQSPSSLSASVGDRVTMTCRASSSVSYMHWYQQTPGKAPKPWIYATSNLASGVPSRFSGSGS
TDYTLTISSLQPEDIATYYCQQWSSNPPTFGQGTKLQITRGGGGSGGGGSGGGGSQVQLVQSGGGVV
QPGRSLRLSCKASGYTFTSYTMHWVRQAPGKGLEWIGYINPSSGYTKYNQKFKDRFTISADKSKSTA
FLQMDSLRPEDTGVYFCARWQDYDVYFDYWGQGTPVTVSS

Humanized anti CD3 scFV clone OKT3 (VH-VL) sequence:
(DNA)

(SEQ ID NO: 387)
caggtgcagctggtgcagagcggaggcggagtggtgcagcctggaagaagcctgcgcctgagctgca
aagcgagcggctataccttaccgctataccatgcattgggtgcgccaggcgccgggcaaaggcct
ggaatggattggctatattaacccgagccgcggctataccaactataaccagaaagtgaaagatcgc
tttaccattagcaccgataaaagcaaaagcaccgcgtttctgcagatggatagcctgcgcccggaag
ataccgcggtgtattattgcgcgcgctattatgatgatcattattgcctggattattggggccaggg
caccaccctgaccgtgagcagcggcggtggcggatccggcggtggcggatccggcggtggcggatcc
gatattcagatgacccagagcccgagcagcctgagcgcgagcgtgggcgatcgcgtgaccattacct
gcagcgcgagcagcagcgtgagctatatgaactggtatcagcagaccccgggcaaagcgccgaaacg
ctggatttatgataccagcaaactggcgagcggcgtgccgagccgctttagcggcagcggcagcggc
accgattataccttaccattagcagcctgcagccggaagatattgcgacctattattgccagcagt
ggagcagcaacccgtttacctttggccagggcaccaaactgcagattacccgc (amino acids)

(SEQ ID NO: 388)
QVQLVQSGGGVVQPGRSLRLSCKASGYTFTRYTMHWVRQAPGKGLEWIGYINPSRGYTNYNQKVKDR
FTISTDKSKSTAFLQMDSLRPEDTAVYYCARYYDDHYCLDYWGQGTTLTVSSGGGGSGGGGSGGGGS
DIQMTQSPSSLSASVGDRVTITCSASSSVSYMNWYQQTPGKAPKRWIYDTSKLASGVPSRFSGSGSG
TDYTFTISSLQPEDIATYYCQQWSSNPFTFGQGTKLQITR

Humanized anti CD3 scFV clone OKT3 (VH-VM) sequence:
(DNA)

(SEQ ID NO: 389)
gatattcagatgacccagagcccgagcagcctgagcgcgagcgtgggcgatcgcgtgaccattacct
gcagcgcgagcagcagcgtgagctatatgaactggtatcagcagaccccgggcaaagcgccgaaacg
ctggatttatgataccagcaaactggcgagcggcgtgccgagccgctttagcggcagcggcagcggc
accgattataccttaccattagcagcctgcagccggaagatattgcgacctattattgccagcagt
ggagcagcaacccgtttacctttggccagggcaccaaactgcagattacccgcggcggtggcggatc
cggcggtggcggatccggcggtggcggatcccaggtgcagctggtgcagagcggaggcggagtggtg
cagcctggaagaagcctgcgcctgagctgcaaagcgagcggctataccttaccgctataccatgc
attgggtgcgccaggcgccgggcaaaggcctggaatggattggctatattaacccgagccgcggcta
taccaactataaccagaaagtgaaagatcgctttaccattagcaccgataaaagcaaaagcaccgcg
tttctgcagatggatagcctgcgcccggaagataccgcggtgtattattgcgcgcgctattatgatg
atcattattgcctggattattggggccagggcaccaccctgaccgtgagcagc (amino acids)

(SEQ ID NO: 390)
DIQMTQSPSSLSASVGDRVTITCSASSSVSYMNWYQQTPGKAPKRWIYDTSKLASGVPSRFSGSGSG
TDYTFTISSLQPEDIATYYCQQWSSNPFTFGQGTKLQITRGGGGSGGGGSGGGGSQVQLVQSGGGVV
QPGRSLRLSCKASGYTFTRYTMHWVRQAPGKGLEWIGYINPSRGYTNYNQKVKDRFTISTDKSKSTA
FLQMDSLRPEDTAVYYCARYYDDHYCLDYWGQGTTLTVSS

HumanizeE6 scFV (VH-VL) sequence:
(DNA)

(SEQ ID NO: 391)
gaggtgcagctggtggagtctgggggaggcctggtcaagcctggggggtccctgagactctcctgtg cagcctctggattcaccttcagtaggtatggcatgagctgggtccgccaggctccagggaagaggct ggagtgggtctcaaccattagtggcggaggcacctacatatactacccagactcagtgaagggccga ttcaccatctccagagacaacgccaagaacaccctgtatctgcaaatgaacagcctgagagccgagg acacggctgtgtattactgtaccagagataactatggccgcaactatgattatggcatggattattg gggccagggcaccctggtgaccgtgagcagcggcggtggcggatccggcggtggcggatccggcggt ggcggatccgaaattgtgttgacacagtctccagccaccctgtctttgtctccaggggaaagagcca ccctcacctgcagcgccaccagcagtgttagctacatccactggtaccaacagaggcctggccagag ccccaggctcctcatctatagcacctccaacctggccagcggcatcccagccaggttcagtggcagt gggtctgggagcgactacactctcaccatcagcagcctagagcctgaagattttgcagtttattact gtcagcagcgtagcagctccccttttacctttggcagcggcaccaaagtggaaattaaa (amino acids)

(SEQ ID NO: 392)
EVQLVESGGGLVKPGGSLRLSCAASGFTFSRYGMSWVRQAPGKRLEWVSTISGGGTYIYYPDSVKGR

FTISRDNAKNTLYLQMNSLRAEDTAVYYCTRDNYGRNYDYGMDYWGQGTLVTVSSGGGGSGGGGSGG

GGSEIVLTQSPATLSLSPGERATLTCSATSSVSYIHWYQQRPGQSPRLLIYSTSNLASGIPARFSGS

GSGSDYTLTISSLEPEDFAVYYCQQRSSSPFTFGSGTKVEIK

HumanizeE6 scFV (VL-VH) sequence:
(DNA)

(SEQ ID NO: 393)
gaaattgtgttgacacagtctccagccaccctgtctttgtctccaggggaaagagccaccctcacct gcagcgccaccagcagtgttagctacatccactggtaccaacagaggcctggccagagccccaggct cctcatctatagcacctccaacctggccagcggcatcccagccaggttcagtggcagtgggtctggg agcgactacactctcaccatcagcagcctagagcctgaagattttgcagtttattactgtcagcagc gtagcagctccccttttacctttggcagcggcaccaaagtggaaattaaaggcggtggcggatccgg cggtggcggatccggcggtggcggatccgaggtgcagctggtggagtctgggggaggcctggtcaag cctggggggtccctgagactctcctgtgcagcctctggattcaccttcagtaggtatggcatgagct gggtccgccaggctccagggaagaggctggagtgggtctcaaccattagtggcggaggcacctacat atactacccagactcagtgaagggccgattcaccatctccagagacaacgccaagaacaccctgtat ctgcaaatgaacagcctgagagccgaggacacggctgtgtattactgtaccagagataactatggcc gcaactatgattatggcatggattattggggccagggcaccctggtgaccgtgagcagc (amino acids)

(SEQ ID NO: 394)
EIVLTQSPATLSLSPGERATLTCSATSSVSYIHWYQQRPGQSPRLLIYSTSNLASGIPARFSGSGSG

SDYTLTISSLEPEDFAVYYCQQRSSSPFTFGSGTKVEIKGGGGSGGGGSGGGGSEVQLVESGGGLVK

PGGSLRLSCAASGFTFSRYGMSWVRQAPGKRLEWVSTISGGGTYIYYPDSVKGRFTISRDNAKNTLY

LQMNSLRAEDTAVYYCTRDNYGRNYDYGMDYWGQGTLVTVSS

HumanizeC2 scFV (VH-VL) sequence:
(DNA)

(SEQ ID NO: 395)
gaggtgcagctggtggagtctgggggaggcctggtcaagcctggggggtccctgagactctcctgtg cagcctctggattcaccttcagtggctatgccatgagctgggtccgccaggctccagggaaggggct ggagtgggtctcaaccattagtagtggcggaaacctacatatactaccccgactcagtgaagggccga ttcaccatctccagagacaacgccaagaactcactgtatctgcaaatgaacagcctgagagccgagg -continued

```
acacggccgtgtattactgtgcgagacttggggggataattactacgaatacttcgatgtctgggg caaagggaccacggtcaccgtctcctccggcggtggcggatccggcggtggcggatccggcggtggc ggatccgacattgtgctgacccagtctccagcctccttggccgtgtctccaggacagagggccacca tcacctgcagagccagtaagagtgtcagtaccagcggatactcctacatgcactggtatcagcagaa accaggacaacctcctaaactcctgatttacctggcatccaatctggagagcggggtcccagccagg ttcagcggcagtgggtctggaccgatttcacccteacaattaatcctgtggaagctaatgatactg caaattattactgtcagcacagtagggagctgccttttcacattcggcggagggaccaaggtggagat caaacgaact
```

(amino acids)
(SEQ ID NO: 396)
```
EVQLVESGGGLVKPGGSLRLSCAASGFTFSGYAMSWVRQAPGKGLEWVSTISSGGTYIYYPDSVKGR
FTISRDNAKNSLYLQMNSLRAEDTAVYYCARLGGDNYYEYFDVWGKGTTVTVSSGGGGSGGGGSGGG
GSDIVLTQSPASLAVSPGQRATITCRASKSVSTSGYSYMHWYQQKPGQPPKLLIYLASNLESGVPAR
FSGSGSGTDFTLTINPVEANDTANYYCQHSRELPFTFGGGTKVEIKRT
```

HumanizeE6 scFV (VL-VH) sequence:
(DNA)
(SEQ ID NO: 397)
```
gacattgtgctgacccagtctccagcctccttggccgtgtctccaggacagagggccaccatcacct gcagagccagtaagagtgtcagtaccagcggatactcctacatgcactggtatcagcagaaaccagg acaacctcctaaactcctgatttacctggcatccaatctggagagcggggtcccagccaggttcagc ggcagtgggtctggaccgatttcacccteacaattaatcctgtggaagctaatgatactgcaaatt attactgtcagcacagtagggagctgccttttcacattcggcggagggaccaaggtggagatcaaacg aactggcggtggcggatccggcggtggcggatccggcggtggcggatccgaggtgcagctggtggag tctgggggaggcctggtcaagcctggggggtccctgagactctcctgtgcagcctctggattcacct tcagtggctatgccatgagctgggtccgccaggctccagggaaggggctggagtgggtctcaaccat tagtagtggcggaacctacatatactaccccgactcagtgaagggccgattcaccatctccagagac aacgccaagaactcactgtatctgcaaatgaacagcctgagagccgaggacacggccgtgtattact gtgcgagacttggggggataattactacgaatacttcgatgtctggggcaaagggaccacggtcac cgtctcctcc
```

(amino acids)
(SEQ ID NO: 398)
```
DIVLTQSPASLAVSPGQRATITCRASKSVSTSGYSYMHWYQQKPGQPPKLLIYLASNLESGVPARFS
GSGSGTDFTLTINPVEANDTANYYCQHSRELPFTFGGGTKVEIKRTGGGGSGGGGSGGGGSEVQLVE
SGGGLVKPGGSLRLSCAASGFTFSGYAMSWVRQAPGKGLEWVSTISSGGTYIYYPDSVKGRFTISRD
NAKNSLYLQMNSLRAEDTAVYYCARLGGDNYYEYFDVWGKGTTVTVSS
```

G$_4$S$_1$ linker sequence:
(DNA)
(SEQ ID NO: 399)
```
ggcggtggcggatcc
```

(amino acids)
(SEQ ID NO:400)
GGGGS

[G$_4$S$_1$]x3 linker sequence:
(DNA)
(SEQ ID NO: 401)
```
ggcggtggcggatccggcggtggcggatccggcggtggcggatcc
```

(amino acids)
(SEQ ID NO: 402)
GGGGSGGGGSGGGGS

-continued 8 aa GS linker sequence:
(DNA)
(SEQ ID NO: 403)
ggcggttccggcggtggatccgga (amino acids)
(SEQ ID NO: 404)
GGSGGGSG 12 aa GS linker sequence:
(DNA)
(SEQ ID NO: 405)
ggcggttccggcggtggatccggcggtggcggatccgga (amino acids)
(SEQ ID NO: 406)
GGSGGGSGGGSG 13 aa GS linker sequence:
(DNA)
(SEQ ID NO: 407)
ggcggtggatccggcggtggcggatccggcggtggatcc (amino acids)
(SEQ ID NO: 408)
GGGSGGGGSGGGS 22 aa GS linker sequence:
(DNA)
(SEQ ID NO: 409)
ggcggtggaagcggcggtggcggatccggcagcggcggaagcggcggtggcggatccggcggtgga (amino acids)
(SEQ ID NO: 4110)
GGGSGGGGSGSGGSGGGGSGGG 24 aa GS linker sequence:
(DNA)
(SEQ ID NO: 411)
ggcggttccggcggtggatccggcggtggcggatccggaggcggttccggcggtggatccggcggtg
gcggatccgga (amino acids)
(SEQ ID NO: 412)
GGSGGGSGGGSGGGSGGGSGGGSG Mouse C3 Heavy chain variable region sequence:
(DNA)
(SEQ ID NO: 413)
caggtccagctgcagcagtctgggcctgagctggtgaggcctggggtctcagtgaagatttcctgcaagggtt ccggctacagattcactgattatgctatgaactgggtgaagcagagtcatgcaaagagtctagagtggattgg agttattagtactttctctggtaatacaaacttcaaccagaagtttaagggcaaggccacaatgactgtagac aaatcctccagcacagcctatatggaacttgccagattgacatctgaggattctgccatgtattactgtgcaa gatcggattactacggcccatactttgactactggggccaaggcaccactctcacagtctcctca (amino acids)
(SEQ ID NO: 414)
QVQLQQSGPELVRPGVSVKISCKGSGYRFTDYAMNWVKQSHAKSLEWIGVISTFSGNTNFNQKFKGKATMTVD
KSSSTAYMELARLTSEDSAMYYCARSDYYGPYFDYWGQGTTLTVSS Mouse C3 heavy chain variable framework region 1 (FWR1) sequence:
(DNA)
(SEQ ID NO: 415)
caggtccagctgcagcagtctgggcctgagctggtgaggcctggggtctcagtgaagatttcctgcaagggtt
ccggctacagattcact (amino acids)
(SEQ ID NO: 416)
QVQLQQSGPELVRPGVSVKISCKGSGYRFT Mouse C3 heavy chain variable complementarity determining regions 1 (CDR1) sequence:
(DNA)
(SEQ ID NO: 417)
gattatgctatgaac (amino acids)
(SEQ ID NO: 418)
DYAMN Mouse C3 heavy chain variable framework region 2 (FWR2) sequence:
(DNA)
(SEQ ID NO: 419)
tgggtgaagcagagtcatgcaaagagtctagagtggattgga (amino acids)
(SEQ ID NO: 420)
WVKQSHAKSLEWIG Mouse C3 heavy chain variable complementarity determining regions 2 (CDR2) sequence:
(DNA)
(SEQ ID NO: 421)
gttattagtactttctctggtaatacaaacttcaaccagaagtttaagggc (amino acids)
(SEQ ID NO: 422)
VISTFSGNINFNQKFKG Mouse C3 heavy chain variable framework region 3 (FWR3) acid sequence:
(DNA)
(SEQ ID NO: 423)
aaggccacaatgactgtagacaaatcctccagcacagcctatatggaacttgccagattgacatctgaggattctgccatgtattactgtgcaaga (amino acids)
(SEQ ID NO: 424)
KATMTVDKSSSTAYMELARLTSEDSAMYYCAR Mouse C3 heavy chain variable complementarity determining regions 3 (CDR3) sequence:
(DNA)
(SEQ ID NO: 425)
tcggattactacggcccatactttgactac (amino acids)
(SEQ ID NO: 426)
SDYYGPYFDY IGHV1-18*04 heavy chain variable region sequence:
(DNA)
(SEQ ID NO: 427)
caggttcagctggtgcagtctggagctgaggtgaagaagcctggggcctcagtgaaggtctcctgca aggcttctggttacacctttaccagctacggtatcagctgggtgcgacaggcccctggacaagggct tgagtggatgggatggatcagcgcttacaatggtaacacaaactatgcacagaagctccagggcaga gtcaccatgaccacagacacatccacgagcacagcctacatggagctgaggagcctgagatctgacg acacggccgtgtattactgtgcgagaga (amino acids)
(SEQ ID NO: 428)
QVQLVQSGAEVKKPGASVKVSCKASGYTFTSYGISWVRQAPGQGLEWMGWISAYNGNINYAQKLQGRVIMITDTSTSTAYMELRSLRSDDTAVYYCAR IGHV1-18*04 heavy chain variable framework region 1 (FWR1) sequence:
(DNA)
(SEQ ID NO: 429)
caggttcagctggtgcagtctggagctgaggtgaagaagcctggggcctcagtgaaggtctcctgcaaggcttctggttacacctttacc (amino acids)
(SEQ ID NO: 430)
QVQLVQSGAEVKKPGASVKVSCKASGYTFT

```
IGHV1-18*04 heavy chain variable complementarity determining regions 1
(CDR1) sequence:
(DNA)
                                                              (SEQ ID NO: 431)
agctacggtatcagc (amino acids)
                                                              (SEQ ID NO: 432)
SYGIS IGHV1-18*04 heavy chain variable framework region 2 (FWR2) sequence:
(DNA)
                                                              (SEQ ID NO: 433)
tgggtgcgacaggcccctggacaagggcttgagtggatggga (amino acids)
                                                              (SEQ ID NO: 434)
WVRQAPGQGLEWMG IGHV1-18*04 heavy chain variable complementarity determining regions 2
(CDR2) sequence:
(DNA)
                                                              (SEQ ID NO: 435)
tggatcagcgcttacaatggtaacacaaactatgcacagaagctccagggc (amino acids)
                                                              (SEQ ID NO: 436)
WISAYNGNTNYAQKLQG IGHV1-18*04 heavy chain variable framework region 3 (FWR3) sequence:
(DNA)
                                                              (SEQ ID NO: 437)
agagtcaccatgaccacagacacatccacgagcacagcctacatggagctgaggagcctgagatctgacgaca
cggccgtgtattactgtgcgaga (amino acids)
                                                              (SEQ ID NO: 438)
RVTMTTDTSTSTAYMELRSLRSDDTAVYYCAR Humanized C3 heavy chain variable region sequence:
(DNA)
                                                              (SEQ ID NO: 439)
caggttcagctggtgcagtctggagctgaggtgaagaagcctggggcctcagtgaaggtctcctgcaaggctt ctggttacacctttaccgactacgccatgaactgggtgcgacaggcccctggacaagggcttgagtggatggg agtgatcagcaccttcagcggtaacacaaacttcaaccagaagttcaagggcagagtcaccatgaccacagac acatccacgagcacagcctacatggagctgaggagcctgagatctgacgacacggccgtgtattactgtgcga gaagcgactactacggcccatacttcgactactggggccagggcaccaccctgaccgtgtccagc (amino acids)
                                                              (SEQ ID NO: 440)
QVQLVQSGAEVKKPGASVKVSCKASGYTFTDYAMNWVRQAPGQGLEWMGVISTFSGNTNFNQKFKGRVTMTTD
TSTSTAYMELRSLRSDDTAVYYCARSDYYGPYFDYWGQGTTLTVSS Humanized C3 heavy chain variable framework region 1 (FWR1) acid
sequence:
(DNA)
                                                              (SEQ ID NO: 441)
caggttcagctggtgcagtctggagctgaggtgaagaagcctggggcctcagtgaaggtctcctgcaaggctt
ctggttacacctttacc (amino acids)
                                                              (SEQ ID NO: 442)
QVQLVQSGAEVKKPGASVKVSCKASGYTFT Humanized C3 heavy chain variable complementarity determining regions 1
(CDR1) sequence:
(DNA)
                                                              (SEQ ID NO: 443)
gactacgccatgaac (amino acids)
                                                              (SEQ ID NO: 444)
DYAMN
```

Humanized C3 heavy chain variable framework region 2 (FWR2) acid
sequence:
(DNA)
(SEQ ID NO: 445)
tgggtgcgacaggcccctggacaagggcttgagtggatggga (amino acids)
(SEQ ID NO: 446)
WVRQAPGQGLEWMG Humanized C3 heavy chain variable complementarity determining regions 2
(CDR2) sequence:
(DNA)
(SEQ ID NO: 447)
gtgatcagcaccttcagcggtaacacaaacttcaaccagaagttcaagggc (amino acids)
(SEQ ID NO: 448)
VISTFSGNTNFNQKFKG Humanized C3 heavy chain variable framework region 3 (FWR3) acid
sequence:
(DNA)
(SEQ ID NO: 449)
agagtcaccatgaccacagacacatccacgagcacagcctacatggagctgaggagcctgagatctgacgaca
cggccgtgtattactgtgcgaga (amino acids)
(SEQ ID NO: 450)
RVTMTTDTSTSTAYMELRSLRSDDTAVYYCAR Humanized C3 heavy chain variable complementarity determining regions 3
(CDR3) sequence:
(DNA)
(SEQ ID NO: 451)
agcgactactacggcccatacttcgactac (amino acids)
(SEQ ID NO: 452)
SDYYGPYFDY Humanized C3 IgG1 heavy chain sequence
(DNA)
(SEQ ID NO: 453)
caggttcagctggtgcagtctggagctgaggtgaagaagcctggggcctcagtgaaggtctcctgcaaggctt ctggttacaccttaccgactacgccatgaactgggtgcgacaggcccctggacaagggcttgagtggatggg agtgatcagcaccttcagcggtaacacaaacttcaaccagaagttcaagggcagagtcaccatgaccacagac acatccacgagcacagcctacatggagctgaggagcctgagatctgacgacacggccgtgtattactgtgcga gaagcgactactacggcccatacttcgactactggggccagggcaccaccctgaccgtgtccagcgctagcac caagggcccatcggtcttccccctggcaccctcctccaagagcacctctgggggcacagcggccctgggctgc ctggtcaaggactacttccccgaaccggtgacggtgtcgtggaactcaggcgccctgaccagcggcgtgcaca ccttcccggctgtcctacagtcctcaggactctactccctcagcagcgtggtgacagtgccctccagcagctt gggcacccagacctacatctgcaacgtgaatcacaagcccagcaacaccaaggtggacaagaaagttgagccc aaatcttgtgacaaaactcacacatgcccaccgtgcccagcacctgaactcctggggggaccgtcagtcttcc tcttccccccaaaacccaaggacaccctcatgatctcccggacccctgaggtcacatgcgtggtggtggacgt gagccacgaagaccctgaggtcaagttcaactggtacgtggacggcgtggaggtgcataatgccaagacaaag ccgcgggaggagcagtacaacagcacgtaccgtgtggtcagcgtcctcaccgtcctgcaccaggactggctga atggcaaggagtacaagtgcaaggtctccaacaaagccctcccagcccccatcgagaaaaccatctccaaagc caaagggcagccccgagaaccacaggtgtacaccctgcccccatcccgggaggagatgaccaagaaccaggtc agcctgacctgcctggtcaaaggcttctatcccagcgacatcgccgtggagtgggagagcaatgggcagccgg -continued agaacaactacaagaccacgcctcccgtgctggactccgacggctccttcttcctctacagcaagctcaccgt ggacaagagcaggtggcagcaggggaacgtcttctcatgctccgtgatgcatgaggctctgcacaaccactac acgcagaagagcctctccctgtctccgggtaaatgataa (amino acids)
(SEQ ID NO: 454)
QVQLVQSGAEVKKPGASVKVSCKASGYTFTDYAMNWVRQAPGQGLEWMGVISTFSGNTNFNQKFKGRVTMTTD

TSTSTAYMELRSLRSDDTAVYYCARSDYYGPYFDYWGQGTTLTVSSASTKGPSVFPLAPSSKSTSGGTAALGC

LVKDYFPEPVTVSWNSGALTSGVHTFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDVSHEDPEVKFNWYVDGVEVHNAKTK

PREEQYNSTYRVVSVLTVLHQDWLNGKEYKCKVSNKALPAPIEKTISKAKGQPREPQVYTLPPSREEMTKNQV

SLTCLVKGFYPSDIAVEWESNGQPENNYKTTPPVLDSDGSFFLYSKLTVDKSRWQQGNVFSCSVMHEALHNHY

TQKSLSLSPGK**

Humanized C3 IgG2 heavy chain sequence
(DNA)
(SEQ ID NO: 455)
caggttcagctggtgcagtctggagctgaggtgaagaagcctggggcctcagtgaaggtctcctgcaaggctt ctggttacacctttaccgactacgccatgaactgggtgcgacaggcccctggacaagggcttgagtggatggg agtgatcagcaccttcagcggtaacacaaacttcaaccagaagttcaagggcagagtcaccatgaccacagac acatccacgagcacagcctacatggagctgaggagcctgagatctgacgacacggccgtgtattactgtgcga gaagcgactactacggcccatacttcgactactggggccagggcaccaccctgaccgtgtccagcgcctccac caagggcccatcggtcttccccctggcgccctgctccaggagcacctccgagagcacagccgccctgggctgc ctggtcaaggactacttccccgaaccggtgacggtgtcgtggaactcaggcgctctgaccagcggcgtgcaca ccttcccagctgtcctacagtcctcaggactctactccctcagcagcgtggtgaccgtgccctccagcaactt cggcacccagacctacacctgcaacgtagatcacaagcccagcaacaccaaggtggacaagacagttgagcgc aaatgttgtgtcgagtgcccaccgtgcccagcaccacctgtggcaggaccgtcagtcttcctcttccccccaa aacccaaggacaccctcatgatctcccggacccctgaggtcacgtgcgtggtggtggacgtgagccacgaaga ccccgaggtccagttcaactggtacgtggacggcgtggaggtgcataatgccaagacaaagccacgggaggag cagttcaacagcacgttccgtgtggtcagcgtcctcaccgttgtgcaccaggactggctgaacggcaaggagt acaagtgcaaggtctccaacaaaggcctcccagcccccatcgagaaaaccatctccaaaaccaaagggcagcc ccgagaaccacaggtgtacaccctgcccccatcccgggaggagatgaccaagaaccaggtcagcctgacctgc ctggtcaaaggcttctaccccagcgacatcgccgtggagtgggagagcaatgggcagccggagaacaactaca agaccacacctcccatgctggactccgacggctccttcttcctctacagcaagctcaccgtggacaagagcag gtggcagcaggggaacgtcttctcatgctccgtgatgcatgaggctctgcacaaccactacacgcagaagagc ctctccctgtctccgggtaaatagtaa (amino acids)
(SEQ ID NO: 456)
QVQLVQSGAEVKKPGASVKVSCKASGYTFTDYAMNWVRQAPGQGLEWMGVISTFSGNTNFNQKFKGRVTMTTD

TSTSTAYMELRSLRSDDTAVYYCARSDYYGPYFDYWGQGTTLTVSSASTKGPSVFPLAPCSRSTSESTAALGC

LVKDYFPEPVTVSWNSGALTSGVHTFPAVLQSSGLYSLSSVVTVPSSNFGTQTYTCNVDHKPSNTKVDKTVER

KCCVECPPCPAPPVAGPSVFLFPPKPKDTLMISRTPEVTCVVVDVSHEDPEVQFNWYVDGVEVHNAKTKPREE

QFNSTFRVVSVLTVVHQDWLNGKEYKCKVSNKGLPAPIEKTISKTKGQPREPQVYTLPPSREEMTKNQVSLTC

LVKGFYPSDIAVEWESNGQPENNYKTTPPMLDSDGSFFLYSKLTVDKSRWQQGNVFSCSVMHEALHNHYTQKS

LSLSPGK**

Humanized C3 heavy chain IgG1 gBLOCK sequence:
(DNA)
(SEQ ID NO: 457)
tgctctgggttccaggttccactggtgacgcggcccagccggcccaggttcagctggtgcagtctggagctga ggtgaagaagcctggggcctcagtgaaggtctcctgcaaggcttctggttacacctttaccgactacgccatg aactgggtgcgacaggcccctggacaagggcttgagtggatgggagtgatcagcaccttcagcggtaacacaa acttcaaccagaagttcaagggcagagtcaccatgaccacagacacatccacgagcacagcctacatggagct gaggagcctgagatctgacgacacggccgtgtattactgtgcgagaagcgactactacggcccatacttcgac tactggggccagggcaccaccctgaccgtgtccagcgctagcaccaaggggcccatcggtcttccccctggcac cctcctccaagagcacctctggggggcacagcggccctgggctgcctggtcaaggactacttccccgaaccggt gacggtgtcgtggaactcaggcgccctgaccagc Mouse C3 Light Chain variable region sequence:
(DNA)
(SEQ ID NO: 458)
gatgttttgatgacccaaactccactctccctgcctgtcagtcttggagatcaagcctccatctcttgcagat ctagtcagaccattgtacatagtaatggaaacacctatttagaatggtacctgcagaaaccaggccagtctcc aaagctcctgatctacaaagtttccaaccgatttctggggtcccagacaggttcagtggcagtggatcaggg acagatttcacactcaagatcaacagagtggaggctgaggatctgggagtttattactgctttcaaggttcac atgttccattcacgttcggctcggggacaaagttggaaataaaa (amino acids)
(SEQ ID NO: 459)
DVLMTQTPLSLPVSLGDQASISCRSSQTIVHSNGNTYLEWYLQKPGQSPKLLIYKVSNRFSGVPDRFSGSGSG
TDFTLKINRVEAEDLGVYYCFQGSHVPFTFGSGTKLEIK Mouse C3 light chain variable framework region 1 (FWR1) sequence :
(DNA)
(SEQ ID NO: 460)
gatgttttgatgacccaaactccactctccctgcctgtcagtcttggagatcaagcctccatctcttgc (amino acids)
(SEQ ID NO: 461)
DVLMTQTPLSLPVSLGDQASISC Mouse C3 light chain variable complementarity determining regions 1
(CDR1) sequence :
(DNA)
(SEQ ID NO: 462)
agatctagtcagaccattgtacatagtaatggaaacacctatttagaa (amino acids)
(SEQ ID NO: 463)
RSSQTIVHSNGNTYLE Mouse C3 light chain variable framework region 2 (FWR2) sequence:
(DNA)
(SEQ ID NO: 464)
tggtacctgcagaaaccaggccagtctccaaagctcctgatctac (amino acids)
(SEQ ID NO: 465)
WYLQKPGQSPKLLIY Mouse C3 light chain variable complementarity determining regions 2
(CDR2) sequence:
(DNA)
(SEQ ID NO: 466)
aaagtttccaaccgatttct (amino acids)
(SEQ ID NO: 467)
KVSNRFS Mouse C3 light chain variable framework region 3 (FWR3) sequence:
(DNA)
(SEQ ID NO: 468)
ggggtcccagacaggttcagtggcagtggatcagggacagatttcacactcaagatcaacagagtggaggctg
aggatctgggagtttattactgc (amino acids)
(SEQ ID NO: 469)
GVPDRFSGSGSGTDFTLKINRVEAEDLGVYYC Mouse C3 light chain variable complementarity determining regions 3
(CDR3) sequence:
(DNA)
(SEQ ID NO: 470)
tttcaaggttcacatgttccattcacg (amino acids)
(SEQ ID NO: 471)
FQGSHVPFT IGKV2-29*03 light chain variable region sequence:
(DNA)
(SEQ ID NO: 472)
gatattgtgatgacccagactccactctctctgtccgtcacccctggacagccggcctccatctcctgcaagt ctagtcagagcctcctgcatagtgatggaaagacctatttgtattggtacctgcagaagccaggccagtctcc acagctcctgatctatgaagtttccagccggttctctggagtgccagataggttcagtggcagcgggtcaggg acagatttcacactgaaaatcagccgggtggaggctgaggatgttggggtttattactgcatgcaaggtatac accttcct (amino acids)
(SEQ ID NO: 473)
DIVMTQTPLSLSVTPGQPASISCKSSQSLLHSDGKTYLYWYLQKPGQSPQLLIYEVSSRFSGVPDRFSGSGSG
TDFTLKISRVEAEDVGVYYCMQGIHLP IGKV2-29*03 light chain variable framework region 1 (FWR1) acid sequence:
(DNA)
(SEQ ID NO: 474)
gatattgtgatgacccagactccactctctctgtccgtcacccctggacagccggcctccatctcctgc (amino acids)
(SEQ ID NO: 475)
DIVMTQTPLSLSVTPGQPASISC IGKV2-29*03 light chain variable complementarity determining regions 1
(CDR1) sequence:
(DNA)
(SEQ ID NO: 476)
aagtctagtcagagcctcctgcatagtgatggaaagacctatttgtat (amino acids)
(SEQ ID NO: 477)
KSSQSLLHSDGKTYLY IGKV2-29*03 light chain variable framework region 2 (FWR2) sequence:
(DNA)
(SEQ ID NO: 478)
tggtacctgcagaagccaggccagtctccacagctcctgatctat (amino acids)
(SEQ ID NO: 479)
WYLQKPGQSPQLLIY IGKV2-29*03 light chain variable complementarity determining regions 2
(CDR2) sequence:
(DNA)
(SEQ ID NO: 480)
gaagtttccagccggttc (amino acids)
(SEQ ID NO: 481)
EVSSRFS IGKV2-29*03 light chain variable framework region 3 (FWR3) sequence:
(DNA)
(SEQ ID NO: 482)
ggagtgccagataggttcagtggcagcgggtcagggacagatttcacactgaaaatcagccgggtggaggctg
aggatgttggggtttattactgc (amino acids)
(SEQ ID NO: 483)
GVPDRFSGSGSGTDFTLKISRVEAEDVGVYYC IGKV2-29*03 light chain variable complementarity determining regions3
(CDR3) sequence:
(DNA)
(SEQ ID NO: 484)
atgcaaggtatacaccttcct (amino acids)
(SEQ ID NO: 485)
MQGIHLP Humanized C3 light chain variable region sequence:
(DNA)
(SEQ ID NO: 486)
gatattgtgatgacccagactccactctctctgtccgtcacccctggacagccggcctccatctcct gcaggtctagtcagaccattgtccatagtaatggaaacacctatttggagtggtacctgcagaagcc aggccagtctccacagctcctgatctataaggtttccaaccggttctctggagtgccagataggttc agtggcagcgggtcagggacagatttcacactgaaaatcagccgggtggaggctgaggatgttgggg tttattactgcttccaaggtagccacgtgcctttcaccttcggcggagggaccaaggtggagatcaa acgaact (amino acids)
(SEQ ID NO: 487)
DIVMTQTPLSLSVTPGQPASISCRSSQTIVHSNGNTYLEWYLQKPGQSPQLLIYKVSNRFSGVPDRF
SGSGSGTDFTLKISRVEAEDVGVYYCFQGSHVPFTFGGGTKVEIKRT Humanized C3 light chain variable framework region 1 (FWR1) acid
sequence:
(DNA)
(SEQ ID NO: 488)
gatattgtgatgacccagactccactctctctgtccgtcacccctggacagccggcctccatctcct
gc (amino acids)
(SEQ ID NO: 489)
DIVMTQTPLSLSVTPGQPASISC Humanized C3 light chain variable complementarity determining regions 1
(CDR1) sequence:
(DNA)
(SEQ ID NO: 490)
ggtctagtcagaccattgtccatagtaatggaaacacctatttggag (amino acids)
(SEQ ID NO: 491)
RSSQTIVHSNGNTYLE Humanized C3 light chain variable framework region 2 (FWR2) acid
sequence:
(DNA)
(SEQ ID NO: 492)
tggtacctgcagaagccaggccagtctccacagctcctgatctat (amino acids)
(SEQ ID NO: 493)
WYLQKPGQSPQLLIY Humanized C3 light chain variable complementarity determining regions 2
(CDR2) sequence:
(DNA)
(SEQ ID NO: 494)
aaggtttccaaccggttctct (amino acids)
(SEQ ID NO: 495)
KVSNRFS Humanized C3 light chain variable framework region 3 (FWR3) acid
sequence:
(DNA)
(SEQ ID NO: 496)
ggagtgccagataggttcagtggcagcgggtcagggacagatttcacactgaaaatcagccgggtggaggctg
aggatgttggggtttattactgc (amino acids)
(SEQ ID NO: 497)
GVPDRFSGSGSGTDFTLKISRVEAEDVGVYYC Humanized C3 light chain variable complementarity determining regions 3 (CDR3) sequence:
(DNA)
(SEQ ID NO: 498)
ttccaaggtagccacgtgcctttcacc (amino acids)
(SEQ ID NO: 499)
FQGSHVPFT Humanized C3 lambda light chain sequence
(DNA)
(SEQ ID NO: 500)
gatattgtgatgacccagactccactctctctgtccgtcacccctggacagccggcctccatctcctgcaggt ctagtcagaccattgtccatagtaatggaaacacctatttggagtggtacctgcagaagccaggccagtctcc acagctcctgatctataaggtttccaaccggttctctggagtgccagataggttcagtggcagcgggtcaggg acagatttcacactgaaaatcagccgggtggaggctgaggatgttggggtttattactgcttccaaggtagcc acgtgcctttcaccttcggcggagggaccaaggtggagatcaaacgaactggtcagcccaaggctgcccccte ggtcactctgttcccgccctcctctgaggagcttcaagccaacaaggccacactggtgtgtctcataagtgac ttctacccgggagccgtgacagtggcctggaaggcagatagcagccccgtcaaggcgggagtggagaccacca cacctccaaacaaagcaacaacaagtacgcggccagcagctatctgagcctgacgcctgagcagtggaagtc ccacagaagctacagctgccaggtcacgcatgaagggagcaccgtggagaagacagtggcccctacagaatgt tcatagtaa (amino acids)
(SEQ ID NO: 501)
DIVMTQTPLSLSVTPGQPASISCRSSQTIVHSNGNTYLEWYLQKPGQSPQLLIYKVSNRFSGVPDRFSGSGSG

TDFTLKISRVEAEDVGVYYCFQGSHVPFTFGGGTKVEIKRTGQPKAAPSVTLFPPSSEELQANKATLVCLISD

FYPGAVTVAWKADSSPVKAGVETTTPSKQSNNKYAASSYLSLTPEQWKSHRSYSCQVTHEGSTVEKTVAPTEC

S**

Humanized C3 Kappa light chain
(DNA)
(SEQ ID NO: 502)
gatattgtgatgacccagactccactctctctgtccgtcacccctggacagccggcctccatctcctgcaggt ctagtcagaccattgtccatagtaatggaaacacctatttggagtggtacctgcagaagccaggccagtctcc acagctcctgatctataaggtttccaaccggttctctggagtgccagataggttcagtggcagcgggtcaggg acagatttcacactgaaaatcagccgggtggaggctgaggatgttggggtttattactgcttccaaggtagcc acgtgcctttcaccttcggcggagggaccaaggtggagatcaaacgaactacggtggctgcaccatctgtctt catcttcccgccatctgatgagcagttgaaatctggaactgcctctgttgtgtgcctgctgaataacttctat cccagagaggccaaagtacagtggaaggtggataacgccctccaatcgggtaactcccaggagagtgtcacag agcaggacagcaaggacagcacctacagcctcagcagcaccctgacgctgagcaaagcagactacgagaaaca caaagtctacgcctgcgaagtcacccatcagggcctgagctcgcccgtcacaaagagcttcaacaggggagag tgttagtaa (amino acids)
(SEQ ID NO: 503)
DIVMTQTPLSLSVTPGQPASISCRSSQTIVHSNGNTYLEWYLQKPGQSPQLLIYKVSNRFSGVPDRFSGSGSG

TDFTLKISRVEAEDVGVYYCFQGSHVPFTFGGGTKVEIKRTTVAAPSVFIFPPSDEQLKSGTASVVCLLNNFY

PREAKVQWKVDNALQSGNSQESVTEQDSKDSTYSLSSTLTLSKADYEKHKVYACEVTHQGLSSPVTKSFNRGE

C**

Humanized C3 Kappa light gBLOCK sequence:
(DNA)

(SEQ ID NO: 504)
agctggctaggtaagcttggtaccgagctcggatccacgccaccatggagacagacacactcctgct atgggtactgctgctctgggttccaggttccactggtgacgatattgtgatgacccagactccactc tctctgtccgtcacccctggacagccggcctccatctcctgcaggtctagtcagaccattgtccata gtaatggaaacacctatttggagtggtacctgcagaagccaggccagtctccacagctcctgatcta taaggtttccaaccggttctctggagtgccagataggttcagtggcagcgggtcagggacagatttc acactgaaaatcagccgggtggaggctgaggatgttgggtttattactgcttccaaggtagccacg tgcctttcaccttcggcggagggaccaaggtggagatcaaacgaactacggtggctgcaccatctgt cttcatcttcccgccatctgatgagcagttgaaatctggaactgcctctgttgtgtgcctgctgaat aacttctatcccagagaggccaaagtacagtggaaggtggataacgccctccaatcgggtaactccc aggagagtgtcacagagcaggacagcaaggacagcacctacagcctcagcagcaccctgacgctgag caaagcagactacgagaaacacaaagtctacgcctgcgaagtcacccatcagggcctgagctcgccc gtcacaaagagcttcaacaggggagagtgttagtaagtttaaacccgctgatcagcctcgactgtgc cttctagttgc Mouse C8 heavy chain variable region sequence
(DNA)

(SEQ ID NO: 505)
gaagtgatggtcgtggaaagcggcggtggtctggtaaagccggggggatcccttaagctttcttgcg ccgcatccgggttcacgttctccggctatgccatgtcctgggtccgacagactcccgaaaagcgctt ggaatgggtggccactatctcctccggggggacgtacatctactaccccgacagtgtgaaaggaaga tttacaatatctcgcgacaacgcaaaaaataccttgtatcttcaaatgagctccctgcggtcagagg acactgccatgtactattgcgcccgcctgggcggcgacaattactatgagtat (amino acids)

(SEQ ID NO: 506)
EVMVVESGGGLVKPGGSLKLSCAASGFTFSGYAMSWVRQTPEKRLEWVATISSGGTYIYYPDSVKGRF
TISRDNAKNTLYLQMSSLRSEDTAMYYCARLGGDNYYEY

Mouse C8 heavy chain variable complementarity determining region 1 (CDR1)
sequence:
(DNA)

(SEQ ID NO: 507)
ggctatgccatgtcc (amino acids)

(SEQ ID NO: 508)
GYAMS

Mouse C8 heavy chain variable complementarity determining region 2 (CDR2)
sequence:
(DNA)

(SEQ ID NO: 509)
actatctcctccggggggacgtacatctactaccccgacagtgtgaaagga (amino acids)

(SEQ ID NO: 510)
TISSGGTYIYYPDSVKG

Mouse C8 heavy chain variable complementarity determining region 3 (CDR3)
sequence:
(DNA)

(SEQ ID NO: 511)
ctgggcggcgacaattactatgagtat (amino acids)

(SEQ ID NO: 512)
LGGDNYYEY

-continued

IGHV3-21*04 heavy chain variable region sequence:
(DNA)
(SEQ ID NO: 513)
gaggtgcagctggtggagtctgggggaggcctggtcaagcctggggggtccctgagactctcctgtg cagcctctggattcaccttcagtagctatagcatgaactgggtccgccaggctccagggaaggggct ggagtgggtctcatccattagtagtagtagtagttacatatactacgcagactcagtgaagggccga ttcaccatctccagagacaacgccaagaactcactgtatctgcaaatgaacagcctgagagccgagg acacggccgtgtattactgtgcga (amino acids)
(SEQ ID NO: 514)
EVQLVESGGGLVKPGGSLRLSCAASGFTFSSYSMNWVRQAPGKGLEWVSSISSSSSYIYYADSVKGRFTISRD
NAKNSLYLQMNSLRAEDTAVYYCAR IGHV3-21*04 heavy chain variable framework region 1 (FWR1) sequence:
(DNA)
(SEQ ID NO: 515)
gaggtgcagctggtggagtctgggggaggcctggtcaagcctggggggtccctgagactctcctgtgcagcct
ctggattcaccttcagt (amino acids)
(SEQ ID NO: 516)
EVQLVESGGGLVKPGGSLRLSCAASGFTFS IGHV3-21*04 heavy chain variable complementarity determining regions 1
(CDR1) sequence:
(DNA)
(SEQ ID NO: 517)
agctatagcatgaac (amino acids)
(SEQ ID NO: 518)
SYSMN IGHV3-21*04 heavy chain variable framework region 2 (FWR2) sequence:
(DNA)
(SEQ ID NO: 519)
tgggtccgccaggctccagggaaggggctggagtgggtc (amino acids)
(SEQ ID NO: 520)
WVRQAPGKGLEWV IGHV3-21*04 heavy chain variable complementarity determining regions 2
(CDR2) sequence:
(DNA)
(SEQ ID NO: 521)
tcatccattagtagtagtagtagttacatatactacgcagactcagtgaagggc (amino acids)
(SEQ ID NO: 522)
SSISSSSSYIYYADSVKG IGHV3-21*04 heavy chain variable framework region 3 (FWR3) sequence:
(DNA)
(SEQ ID NO: 523)
cgattcaccatctccagagacaacgccaagaactcactgtatctgcaaatgaacagcctgagagccgaggaca
cggccgtgtattactgtgcga (amino acids)
(SEQ ID NO: 524)
RFTISRDNAKNSLYLQMNSLRAEDTAVYYCAR Humanized C8 heavy chain variable region sequence:
(DNA)
(SEQ ID NO: 525)
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccctgactcagtgaagggccgattcaccatctccagagac aacgccaagaactcactgtatctgcaaatgaacagcctgagagccgaggacacggccgtgtattactgtgcga gactgggcggcgataactattatgaatattggggcaaagggaccacggtcaccgtctcctcc (amino acids)

(SEQ ID NO: 526)
EVQLVESGGGLVKPGGSLRLSCAASGFTFSGYAMSWVRQAPGKGLEWVSTISSGGTYIYYPDSVKGRFTISRD
NAKNSLYLQMNSLRAEDTAVYYCARLGGDNYYEYWGKGTTVTVSS

Humanized C8 heavy chain variable framework region 1 (FWR1) sequence:
(DNA)

(SEQ ID NO: 527)
gaggtgcagctggtggagtctgggggaggcctggtcaagcctggggggtccctgagactctcctgtgcagcct
ctggattcaccttcagt (amino acids)

(SEQ ID NO: 528)
EVQLVESGGGLVKPGGSLRLSCAASGFTFS

Humanized C8 heavy chain variable complementarity determining region 1
(CDR1) sequence:
(DNA)

(SEQ ID NO: 529)
ggctatgccatgagc (amino acids)

(SEQ ID NO: 530)
GYAMS

Humanized C8 heavy chain variable framework region 2 (FWR2) sequence:
(DNA)

(SEQ ID NO: 531)
tgggtccgccaggctccagggaaggggctggagtgggtctca (amino acids)

(SEQ ID NO: 532)
WVRQAPGKGLEWVS

Humanized C8 heavy chain variable complementarity determining region 2
(CDR2) sequence:
(DNA)

(SEQ ID NO: 533)
accattagtagtggcggaacctacatatactaccctgactcagtgaagggc (amino acids)

(SEQ ID NO: 534)
TISSGGTYIYYPDSVKG

Humanized C8 heavy chain variable framework region 3 (FWR3) sequence:
(DNA)

(SEQ ID NO: 535)
cgattcaccatctccagagacaacgccaagaactcactgtatctgcaaatgaacagcctgagagccgaggaca
cggccgtgtattactgtgcgaga (amino acids)

(SEQ ID NO: 536)
RFTISRDNAKNSLYLQMNSLRAEDTAVYYCAR

Humanized C8 heavy chain variable complementarity determining region 3
(CDR3) sequence:
(DNA)

(SEQ ID NO: 537)
ctgggcggcgataactattatgaatat (amino acids)

(SEQ ID NO: 538)
LGGDNYYEY

Humanized C8 IgG1 heavy chain sequence
(DNA)

(SEQ ID NO: 539)
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccctgactcagtgaagggccgattcaccatctccagagac aacgccaagaactcactgtatctgcaaatgaacagcctgagagccgaggacacggccgtgtattactgtgcga gactgggcggcgataactattatgaatattggggcaaagggaccacggtcaccgtctcctccgctagcaccaa gggcccatcggtcttccccctggcaccctcctccaagagcacctctgggggcacagcggccctgggctgcctg gtcaaggactacttccccgaaccggtgacggtgtcgtggaactcaggcgccctgaccagcggcgtgcacacct -continued tcccggctgtcctacagtcctcaggactctactccctcagcagcgtggtgacagtgccctccagcagcttggg cacccagacctacatctgcaacgtgaatcacaagcccagcaacaccaaggtggacaagaaagttgagcccaaa tcttgtgacaaaactcacacatgcccaccgtgcccagcacctgaactcctggggggaccgtcagtcttcctct tccccccaaaacccaaggacaccctcatgatctcccggacccctgaggtcacatgcgtggtggtggacgtgag ccacgaagaccctgaggtcaagttcaactggtacgtggacggcgtggaggtgcataatgccaagacaaagccg cgggaggagcagtacaacagcacgtaccgtgtggtcagcgtcctcaccgtcctgcaccaggactggctgaatg gcaaggagtacaagtgcaaggtctccaacaaagcccccagccccatcgagaaaaccatctccaaagccaa agggcagccccgagaaccacaggtgtacaccctgcccccatcccgggaggagatgaccaagaaccaggtcagc ctgacctgcctggtcaaaggcttctatcccagcgacatcgccgtggagtgggagagcaatgggcagccggaga acaactacaagaccacgcctcccgtgctggactccgacggctccttcttcctctacagcaagctcaccgtgga caagagcaggtggcagcaggggaacgtcttctcatgctccgtgatgcatgaggctctgcacaaccactacacg cagaagagcctctccctgtctccgggtaaatgataa (amino acids)
(SEQ ID NO: 540)
EVQLVESGGGLVKPGGSLRLSCAASGFTFSGYAMSWVRQAPGKGLEWVSTISSGGTYIYYPDSVKGRFTISRD

NAKNSLYLQMNSLRAEDTAVYYCARLGGDNYYEYWGKGTTVTVSSASTKGPSVFPLAPSSKSTSGGTAALGCL

VKDYFPEPVTVSWNSGALTSGVHTFPAVLQSSGLYSLSSVVTVPSSSLGTQTYICNVNHKPSNTKVDKKVEPK

SCDKTHTCPPCPAPELLGGPSVFLFPPKPKDTLMISRTPEVTCVVVDVSHEDPEVKFNWYVDGVEVHNAKTKP

REEQYNSTYRVVSVLTVLHQDWLNGKEYKCKVSNKALPAPIEKTISKAKGQPREPQVYTLPPSREEMTKNQVS

LTCLVKGFYPSDIAVEWESNGQPENNYKTTPPVLDSDGSFFLYSKLTVDKSRWQQGNVFSCSVMHEALHNHYT

QKSLSLSPGK**

Humanized C8 IgG2 heavy chain sequence
(DNA)
(SEQ ID NO: 541)
gaggtgcagctggtggagtctgggggaggcctggtcaagcctggggggtccctgagactctcctgtgcagcct ctggattcaccttcagtggctatgccatgagctgggtccgccaggctccagggaaggggctggagtgggtctc aaccattagtagtggcggaacctacatatactaccctgactcagtgaagggccgattcaccatctccagagac aacgccaagaactcactgtatctgcaaatgaacagcctgagagccgaggacacggccgtgtattactgtgcga gactgggcggcgataactattatgaatattggggcaaagggaccacggtcaccgtctcctccgcctccaccaa gggcccatcggtcttccccctggcgccctgctccaggagcacctccgagagcacagccgccctgggctgcctg gtcaaggactacttccccgaaccggtgacggtgtcgtggaactcaggcgctctgaccagcggcgtgcacacct tcccagctgtcctacagtcctcaggactctactccctcagcagcgtggtgaccgtgccctccagcaacttcgg cacccagacctacacctgcaacgtagatcacaagcccagcaacaccaaggtggacaagacagttgagcgcaaa tgttgtgtcgagtgcccaccgtgcccagcaccacctgtggcaggaccgtcagtcttcctcttccccccaaaac ccaaggacaccctcatgatctcccggacccctgaggtcacgtgcgtggtggtggacgtgagccacgaagaccc cgaggtccagttcaactggtacgtggacggcgtggaggtgcataatgccaagacaaagccacgggaggagcag ttcaacagcacgttccgtgtggtcagcgtcctcaccgttgtgcaccaggactggctgaacggcaaggagtaca agtgcaaggtctccaacaaaggcctcccagccccatcgagaaaaccatctccaaaaccaaagggcagccccg agaaccacaggtgtacaccctgcccccatcccgggaggagatgaccaagaaccaggtcagcctgacctgcctg gtcaaaggcttctaccccagcgacatcgccgtggagtgggagagcaatgggcagccggagaacaactacaaga ccacacctcccatgctggactccgacggctccttcttcctctacagcaagctcaccgtggacaagagcaggtg gcagcaggggaacgtcttctcatgctccgtgatgcatgaggctctgcacaaccactacacgcagaagagcctc tccctgtctccgggtaaatagtaa -continued (amino acids)

(SEQ ID NO: 542)

EVQLVESGGGLVKPGGSLRLSCAASGFTFSGYAMSWVRQAPGKGLEWVSTISSGGTYIYYPDSVKGRFTISRD
NAKNSLYLQMNSLRAEDTAVYYCARLGGDNYYEYWGKGTTVTVSSASTKGPSVFPLAPCSRSTSESTAALGCL
VKDYFPEPVTVSWNSGALTSGVHTFPAVLQSSGLYSLSSVVTVPSSNFGTQTYTCNVDHKPSNTKVDKTVERK
CCVECPPCPAPPVAGPSVFLFPPKPKDTLMISRTPEVTCVVVDVSHEDPEVQFNWYVDGVEVHNAKTKPREEQ
FNSTFRVVSVLTVVHQDWLNGKEYKCKVSNKGLPAPIEKTISKTKGQPREPQVYTLPPSREEMTKNQVSLTCL
VKGFYPSDIAVEWESNGQPENNYKTTPPMLDSDGSFFLYSKLTVDKSRWQQGNVFSCSVMHEALHNHYTQKSL
SLSPGK**

Mouse C8 light chain variable region sequence
(DNA)

(SEQ ID NO: 543)

gacatcgtcattacgcagacccctgccagtcttgccgtttctctgggccagagggccactatcagttacaggg
cgagtaagtctgtgagtaccagcggctatagttacatgcattggaaccagcagaaaccgggacagccaccacg
cctgcttatttatctggtgtctaatcttgagtccggggtgcccgccaggttcagcggcagcggctctgggacc
gacttcacactcaacattcatccagtggaagaagaggacgctgctacatactactgtcaacacattcgggaac
tgaccaggagtgaa (amino acids)

(SEQ ID NO: 544)

DIVITQTPASLAVSLGQRATISYRASKSVSTSGYSYMHWNQQKPGQPPRLLIYLVSNLESGVPARFS
GSGSGTDFTLNIHPVEEEDAATYYCQHIRELTRSE

Mouse C8 light chain variable complementarity determining region 1 (CDR1)
sequence:
(DNA)

(SEQ ID NO: 545)

agggcgagtaagtctgtgagtaccagcggctatagttacatgcat (amino acids)

(SEQ ID NO: 546)

RASKSVSTSGYSYMH

Mouse C8 light chain variable complementarity determining region 2 (CDR2)
sequence:
(DNA)

(SEQ ID NO: 547)

ctggtgtctaatcttgagtcc (amino acids)

(SEQ ID NO: 548)

LVSNLES

Mouse C8 light chain variable complementarity determining region 3 (CDR3)
sequence:
(DNA)

(SEQ ID NO: 549)

caacacattcgggaactgaccaggagtgaa (amino acids)

(SEQ ID NO: 550)

QHIRELTRSE

NCBI germline z00023 light chain variable region sequence:
(DNA)

(SEQ ID NO: 551)

gacatcgtgatgacccagtctccagactccctggctgtgtctctgggcgagagggccaccatcaactgcaagt
ccagccagagtgttttatacagctccaacaataagaactacttagcttggtaccagcagaaaccaggacagcc
tcctaagctgctcatttactgggcatctacccgggaatccggggtccctgaccgattcagtggcagcgggtct
gggacagatttcactctcaccatcagcagcctgcaggctgaagatgtggcagtttattactgtcagcaatatt
atagtactcct (amino acids)

(SEQ ID NO: 552)

DIVMTQSPDSLAVSLGERATINCKSSQSVLYSSNNKNYLAWYQQKPGQPPKLLIYWASTRESGVPDRFSGSGS
GTDFTLTISSLQAEDVAVYYCQQYYSTP

-continued

NCBI germline z00023 light chain variable framework region 1 (FWR1) acid sequence:
(DNA)
(SEQ ID NO: 553)
gacatcgtgatgacccagtctccagactccctggctgtgtctctgggcgagagggccaccatcaactgc (amino acids)
(SEQ ID NO: 554)
DIVMTQSPDSLAVSLGERATINC NCBI germline z00023 light chain variable complementarity determining regions 1 (CDR1) sequence:
(DNA)
(SEQ ID NO: 555)
aagtccagccagagtgttttatacagctccaacaataagaactacttagct (amino acids)
(SEQ ID NO: 556)
KSSQSVLYSSNNKNYLA NCBI germline z00023 light chain variable framework region 2 (FWR2) sequence:
(DNA)
(SEQ ID NO: 557)
tggtaccagcagaaaccaggacagcctcctaagctgctcatttac (amino acids)
(SEQ ID NO: 558)
WYQQKPGQPPKLLIY NCBI germline z00023 light chain variable complementarity determining regions 2 (CDR2) sequence:
(DNA)
(SEQ ID NO: 559)
tgggcatctacccgggaatcc (amino acids)
(SEQ ID NO: 560)
WASTRES NCBI germline z00023 light chain variable framework region 3 (FWR3) sequence:
(DNA)
(SEQ ID NO: 561)
ggggtccctgaccgattcagtggcagcgggtctgggacagatttcactctcaccatcagcagcctgcaggctg
aagatgtggcagttttattactgt (amino acids)
(SEQ ID NO: 562)
GVPDRFSGSGSGTDFTLTISSLQAEDVAVYYC NCBI germline z00023 light chain variable complementarity determining regions3 (CDR3) sequence:
(DNA)
(SEQ ID NO: 563)
cagcaatattatagtactcct (amino acids)
(SEQ ID NO: 564)
QQYYSTP Humanized C8 light chain variable region sequence
(DNA)
(SEQ ID NO: 565)
gacatcgtgatgacccagtctccagactccctggctgtgtctctgggcgagagggccaccatcaact gcagggccagcaagagtgttagcaccagcggctacagctacatgcactggtaccagcagaaaccagg acagcctcctaagctgctcatttacctggtgtctaacctggaatccggggtccctgaccgattcagt ggcagcgggtctgggacagatttcactctcaccatcagcagcctgcaggctgaagatgtggcagttt attactgtcaacacattcgggaactgaccaggagtgaattcggcggagggaccaaggtggagatcaa acgaact (amino acids)
(SEQ ID NO: 566)
DIVMTQSPDSLAVSLGERATINCRASKSVSTSGYSYMHWYQQKPGQPPKLLIYLVSNLESGVPDRFS
GSGSGTDFTLTISSLQAEDVAVYYCQHIRELTRSEFGGGTKVEIKRT Humanized C8 light chain variable framework region 1 (FWR1) sequence:
(DNA)

(SEQ ID NO: 567)
gacatcgtgatgacccagtctccagactccctggctgtgtctctgggcgagagggccaccatcaact
gc (amino acids)

(SEQ ID NO: 568)
DIVMTQSPDSLAVSLGERATINC

Humanized C8 light chain variable complementarity determining region 1 (CDR1) sequence:
(DNA)

(SEQ ID NO: 569)
agggccagcaagagtgttagcaccagcggctacagctacatg (amino acids)

(SEQ ID NO: 570)
RASKSVSTSGYSYM

Humanized C8 light chain variable framework region 2 (FWR2) sequence:
(DNA)

(SEQ ID NO: 571)
cactggtaccagcagaaaccaggacagcctcctaagctgctcatttac (amino acids)

(SEQ ID NO: 572)
HWYQQKPGQPPKLLIY

Humanized C8 light chain variable complementarity determining region 2 (CDR2) sequence:
(DNA)

(SEQ ID NO: 573)
ctggtgtctaacctggaatcc (amino acids)

(SEQ ID NO: 574)
LVSNLES

Humanized C8 light chain variable framework region 3 (FWR3) sequence:
(DNA)

(SEQ ID NO: 575)
ggggtccctgaccgattcagtggcagcgggtctgggacagatttcactctcaccatcagcagcctgcaggctg
aagatgtggcagtttattactgt (amino acids)

(SEQ ID NO: 576)
GVPDRFSGSGSGTDFTLTISSLQAEDVAVYYC

Humanized C8 light chain variable complementarity determining region 3 (CDR3) sequence:
(DNA)

(SEQ ID NO: 577)
caacacattcgggaactgaccaggagtgaa (amino acids)

(SEQ ID NO: 578)
QHIRELTRSE

Humanized C8 Lambda light chain sequence
(DNA)

(SEQ ID NO: 579)
gacatcgtgatgacccagtctccagactccctggctgtgtctctgggcgagagggccaccatcaactgcaggg ccagcaagagtgttagcaccagcggctacagctacatgcactggtaccagcagaaaccaggacagcctcctaa gctgctcatttacctggtgtctaacctggaatccggggtccctgaccgattcagtggcagcgggtctgggaca gatttcactctcaccatcagcagcctgcaggctgaagatgtggcagtttattactgtcaacacattcgggaac tgaccaggagtgaattcggcggagggaccaaggtggagatcaaacgaactggtcagcccaaggctgccccctc ggtcactctgttcccgccctctctgaggagcttcaagccaacaaggccacactggtgtgtctcataagtgac ttctacccgggagccgtgacagtggcctggaaggcagatagcagccccgtcaaggcgggagtggagaccacca

```
caccctccaaacaaagcaacaacaagtacgcggccagcagctatctgagcctgacgcctgagcagtggaagtc ccacagaagctacagctgccaggtcacgcatgaagggagcaccgtggagaagacagtggcccctacagaatgt tcatagtaa
```

(amino acids)

(SEQ ID NO: 580)
```
DIVMTQSPDSLAVSLGERATINCRASKSVSTSGYSYMHWYQQKPGQPPKLLIYLVSNLESGVPDRFSGSGSGT

DFTLTISSLQAEDVAVYYCQHIRELTRSEFGGGTKVEIKRTGQPKAAPSVTLFPPSSEELQANKATLVCLISD

FYPGAVTVAWKADSSPVKAGVETTTPSKQSNNKYAASSYLSLTPEQWKSHRSYSCQVTHEGSTVEKTVAPTEC

S**
```

Humanized C8 Kappa light chain sequence
(DNA)

(SEQ ID NO: 581)
```
gacatcgtgatgacccagtctccagactccctggctgtgtctctgggcgagagggccaccatcaactgcaggg ccagcaagagtgttagcaccagcggctacagctacatgcactggtaccagcagaaaccaggacagcctcctaa gctgctcatttacctggtgtctaacctggaatccggggtccctgaccgattcagtggcagcgggtctgggaca gatttcactctcaccatcagcagcctgcaggctgaagatgtggcagtttattactgtcaacacattcgggaac tgaccaggagtgaattcggcggagggaccaaggtggagatcaaacgaactacggtggctgcaccatctgtctt catcttcccgccatctgatgagcagttgaaatctggaactgcctctgttgtgtgcctgctgaataacttctat cccagagaggccaaagtacagtggaaggtggataacgccctccaatcgggtaactcccaggagagtgtcacag agcaggacagcaaggacagcacctacagcctcagcagcaccctgacgctgagcaaagcagactacgagaaaca caaagtctacgcctgcgaagtcacccatcagggcctgagctcgcccgtcacaaagagcttcaacaggggagag tgttagtaa
```

(amino acids)

(SEQ ID NO: 582)
```
DIVMTQSPDSLAVSLGERATINCRASKSVSTSGYSYMHWYQQKPGQPPKLLIYLVSNLESGVPDRFSGSGSGT

DFTLTISSLQAEDVAVYYCQHIRELTRSEFGGGTKVEIKRTTVAAPSVFIFPPSDEQLKSGTASVVCLLNNFY

PREAKVQWKVDNALQSGNSQESVTEQDSKDSTYSLSSTLTLSKADYEKHKVYACEVTHQGLSSPVTKSFNRGE

C**
```

Humanized C8 Kappa light chain gBLOCk sequence:
(DNA)

(SEQ ID NO: 583)
```
agctggctaggtaagcttggtaccgagctcggatccacgccaccatggagacagacacactcctgctatgggt actgctgctctgggttccaggttccactggtgacgacatcgtgatgacccagtctccagactccctggctgtg tctctgggcgagagggccaccatcaactgcagggccagcaagagtgttagcaccagcggctacagctacatgc actggtaccagcagaaaccaggacagcctcctaagctgctcatttacctggtgtctaacctggaatccggggt ccctgaccgattcagtggcagcgggtctgggacagatttcactctcaccatcagcagcctgcaggctgaagat gtggcagtttattactgtcaacacattcgggaactgaccaggagtgaattcggcggagggaccaaggtggaga tcaaacgaactacggtggctgcaccatctgtcttcatcttcccgccatctgatgagcagttgaaatctggaac tgcctctgttgtgtgcctgctgaataacttctatcccagagaggccaaagtacagtggaaggtggataacgcc ctccaatcgggtaactcccaggagagtgtcacagagcaggacagcaaggacagcacctacagcctcagcagca ccctgacgctgagcaaagcagactacgagaaacacaaagtctacgcctgcgaagtcacccatcagggcctgag ctcgcccgtcacaaagagcttcaacaggggagagtgttagtaagtttaaacccgctgatcagcctcgactgtg ccttctagttgc
```

-continued

CAR-T E6 CD8 sequence:
(DNA)

(SEQ ID NO: 584)

gaggtccagctggttgagagtggcggtgggctggttaagcctggcggctccctgcggctgagctgcgccgcga gtggatttactttcagccgatatgggatgagttgggtgcggcaagctcccgggaagaggctggaatgggtctc aacaatctccggggggggcacttacatctattaccccgactcagtcaaggggagatttaccatttcacgagac aacgctaagaatacccctgtatttgcagatgaattctctgagagcagaggacacagctgtttactattgtaccc gcgacaactatggcaggaactacgactacggtatggactattgggacaagggacattggttacagtgagcag tggcggcggggcagcggaggaggaggcagcggtggggggggcagcgagatagtgctcacgcagtcaccgcg actctcagtctctcacctggggaacgagctaccctgacgtgctctgctacctcctcagtgtcatatattcact ggtatcagcaacgcccggcagtcccctagattgctcatttatagtacctctaatctggcctcaggtatccc tgcacgattttctggatctggttcaggttctgattacaccctcactatctctagcctggagcctgaagacttt gccgtttattactgccagcagaggtctagctccccattcacctttgggagtgggaccaaggttgaaattaaaa cgacaaccccggccccagaccaccaacgccagccccaccatcgccagccaaccctgtctctgagaccaga agcctgtaggcctgccgccggtggagctgtgcacacaagaggactggatttcgcctgtgatatctacatttgg gccccgctcgcaggcacatgtggagtgctcctcctctccctggtgattaccctgtactgctgataa (amino acids)

(SEQ ID NO: 585)

EVQLVESGGGLVKPGGSLRLSCAASGFTFSRYGMSWVRQAPGKRLEWVSTISGGGTYIYYPDSVKGR

FTISRDNAKNTLYLQMNSLRAEDTAVYYCTRDNYGRNYDYGMDYWGQGTLVTVSSGGGGSGGGGSGG

GGSEIVLTQSPATLSLSPGERATLTCSATSSVSYIHWYQQRPGQSPRLLIYSTSNLASGIPARFSGS

GSGSDYTLTISSLEPEDFAVYYCQQRSSSPFTFGSGTKVEIKTTTPAPRPPTPAPTIASQPLSLRPE

ACRPAAGGAVHTRGLDFACDIYIWAPLAGTCGVLLLSLVITLYC**

CAR-T C2 CD8 sequence:
(DNA)

(SEQ ID NO: 586)

gaagtgcagctcgtagagagtggcggggggactggtgaagcccggtggaagcctcagactcagttgcg ccgcctcaggttttcactttttcaggttacgccatgtcctgggtaagacaggcaccggggaaaggact cgagtgggtgtctactatcagctcaggaggcacttatatatattatcctgactctgtaaaaggccga tttacgatttctcgcgacaatgcaaagaactccctctacctccaaatgaacagtcttagggcagaag acactgctgtatactattgtgcacgcctcggcggcgacaactactacgagtactttgacgtgtgggg gaaagggactaccgtgacagtttcaagcggaggaggtggctcaggtggaggcgggtcaggggggga ggaagtgatattgtgctcacacaatccccagcctcctggctgtgtctcccggccaacgcgctacaa ttacatgtcgggcctccaaaagcgtgagcaccagcggctacagctacatgcactggtatcaacagaa accaggacaaccccccaaactgttgatttatctcgcttcaaacttggagtccggcgtgcctgcgcgc ttttcagggagtgggagcggcacagattttacgctgactatcaaccccgtagaagcaaacgatacag cgaattattattgtcaacattcccgggaactccccttttacgttcggcgggggcacaaaggtcgaaat taagagaaccacgacaaccccggcccccagaccaccaacgccagccccaccatcgccagccaaccc ctgtctctgagaccagaagcctgtaggcctgccgccggtggagctgtgcacacaagaggactggatt tcgcctgtgatatctacatttgggccccgctcgcaggcacatgtggagtgctcctcctctccctggt gattaccctgtactgctgataa (amino acids)

(SEQ ID NO: 587)

EVQLVESGGGLVKPGGSLRLSCAASGFTFSGYAMSWVRQAPGKGLEWVSTISSGGTYIYYPDSVKGR

FTISRDNAKNSLYLQMNSLRAEDTAVYYCARLGGDNYYEYFDVWGKGTTVTVSSGGGGSGGGGSGGG

-continued

```
GSDIVLTQSPASLAVSPGQRATITCRASKSVSTSGYSYMHWYQQKPGQPPKLLIYLASNLESGVPAR

FSGSGSGTDFTLTINPVEANDTANYYCQHSRELPFTFGGGTKVEIKRTTTTPAPRPPTPAPTIASQP

LSLRPEACRPAAGGAVHTRGLDFACDIYIWAPLAGTCGVLLLSLVITLYC**
```

CD8/4-1BB sequence
(DNA)

(SEQ ID NO: 588)
```
acgacaaccccggcccccagaccaccaacgccagcccccaccatcgccagccaaccccctgtctctga gaccagaagcctgtaggcctgccgccggtggagctgtgcacacaagaggactggatttcgcctgtga tatctacatttgggccccgctcgcaggcacatgtggagtgctcctcctctccctggtgattaccctg tactgcaaaaggggccgcaaaaaactcctttacatttttaagcagcctttttatgaggccagtacaga cgactcaagaggaagacgggtgctcatgccgctttcctgaggaggaggaaggagggtgcgaactgtg ataa
```

(amino acids)

(SEQ ID NO: 589)
```
TTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCEL**
```

CD8/CD28 sequence
(DNA)

(SEQ ID NO: 590)
```
acgacaaccccggcccccagaccaccaacgccagcccccaccatcgccagccaaccccctgtctctga gaccagaagcctgtaggcctgccgccggtggagctgtgcacacaagaggactggatttcgcctgtga tatctacatttgggccccgctcgcaggcacatgtggagtgctcctcctctccctggtgattaccctg tactgcagaagcaagcggtctcggctcctgcattctgattacatgaacatgaccccaagaagaccag gccccaccaggaaacattaccagccctacgctccgccacgcgacttcgctgcctaccggtcctgata a
```

(amino acids)

(SEQ ID NO: 591)
```
TTTPAPRPPTPAPTIASQPLSLRPEACRPAAGGAVHTRGLDFACDIYIWAPLAGTCGVLLLSLVITL
YCRSKRSRLLHSDYMNMTPRRPGPTRKHYQPYAPPRDFAAYRS**
```

CD8/CD3z sequence:
(DNA)

(SEQ ID NO: 592)
```
acgacaaccccggcccccagaccaccaacgccagcccccaccatcgccagccaaccccctgtctctga gaccagaagcctgtaggcctgccgccggtggagctgtgcacacaagaggactggatttcgcctgtga tatctacatttgggccccgctcgcaggcacatgtggagtgctcctcctctccctggtgattaccctg tactgccgcgttaagttctcccgatcagccgacgcgcctgcttacaagcagggccagaaccaactgt acaacgagctgaatctcggtagacgggaagagtacgacgtgttggacaaacggagaggccgcgaccc agaaatgggcggcaagcctcgcaggaaaaaccccaggagggactgtacaatgagttgcagaaagat aagatggcagaagcttatagcgagatcggaatgaaggggaaggagacgagggaaggacacgacg gcctttatcagggcctgtccacagcaacaaaagatacgtatgacgccctccatatgcaggcacttcc accacggtgataa
```

(amino acids)

(SEQ ID NO: 593)
```
TTTPAPRPPTPAPTIASQPLSLRPEACRPAAGGAVHTRGLDFACDIYIWAPLAGTCGVLLLSLVITL
YCRVKFSRSADAPAYKQGQNQLYNELNLGRREEYDVLDKRRGRDPEMGGKPRRKNPQEGLYNELQKD
KMAEAYSEIGMKGERRRGKGHDGLYQGLSTATKDTYDALHMQALPPR**
```

CD8/CD28/CD3z sequence:
(DNA)

(SEQ ID NO: 594)
```
acgacaaccccggcccccagaccaccaacgccagcccccaccatcgccagccaaccccctgtctctga gaccagaagcctgtaggcctgccgccggtggagctgtgcacacaagaggactggatttcgcctgtga tatctacatttgggccccgctcgcaggcacatgtggagtgctcctcctctccctggtgattaccctg
```

-continued tactgcagaagcaagcggtctcggctcctgcattctgattacatgaacatgacccc aagaagaccag gccccaccaggaaacattaccagccctacgctccgccacgcgacttcgctgcctaccggtcccgcgt taagttctcccgatcagccgacgcgcctgcttacaagcagggccagaaccaactgtacaacgagctg aatctcggtagacgggaagagtacgacgtgttggacaaacggagaggccgcgacccagaaatgggcg gcaagcctcgcaggaaaaaccccc aggagggactgtacaatgagttgcagaaagataagatggcaga agcttatagcgagatcggaatgaaggggg aaggagacgagggaaaggacacgacggcctttatcag ggcctgtccacagcaacaaaagatacgtatgacgccctccatatgcaggcacttccaccacggtgat aa (amino acids)

(SEQ ID NO: 595)
TTTPAPRPPTPAPTIASQPLSLRPEACRPAAGGAVHTRGLDFACDIYIWAPLAGTCGVLLLSLVITL

YCRSKRSRLLHSDYMNMTPRRPGPTRKHYQPYAPPRDFAAYRSRVKFSRSADAPAYKQGQNQLYNEL

NLGRREEYDVLDKRRGRDPEMGGKPRRKNPQEGLYNELQKDKMAEAYSEIGMKGERRRGKGHDGLYQ

GLSTATKDTYDALHMQALPPR**

CD8/4-1BB/CD3z sequence:
(DNA)

(SEQ ID NO: 596)
acgacaaccccggcccc agaccaccaacgccagcccccaccatcgccagccaaccc ctgtctctga gaccagaagcctgtaggcctgccgccggtggagctgtgcacacaagaggactggatttcgcctgtga tatctacatttgggccccgctcgcaggcacatgtggagtgctcctcctctccctggtgattaccctg tactgcaaaaggggccgcaaaaaactcctttacatttttaagcagccttttatgaggccagtacaga cgactcaagaggaagacgggtgctcatgccgctttcctgaggaggaggaaggagggtgcgaactgcg cgttaagttctcccgatcagccgacgcgcctgcttacaagcagggccagaaccaactgtacaacgag ctgaatctcggtagacgggaagagtacgacgtgttggacaaacggagaggccgcgacccagaaatgg gcggcaagcctcgcaggaaaaaccccc aggagggactgtacaatgagttgcagaaagataagatggc agaagcttatagcgagatcggaatgaaggggg aaggagacgagggaaaggacacgacggcctttat cagggcctgtccacagcaacaaaagatacgtatgacgccctccatatgcaggcacttccaccacggt gataa (amino acids)

(SEQ ID NO: 597)
TTTPAPRPPTPAPTIASQPLSLRPEACRPAAGGAVHTRGLDFACDIYIWAPLAGTCGVLLLSLVITL

YCKRGRKKLLYIFKQPFMRPVQTTQEEDGCSCRFPEEEEGGCELRVKFSRSADAPAYKQGQNQLYNE

LNLGRREEYDVLDKRRGRDPEMGGKPRRKNPQEGLYNELQKDKMAEAYSEIGMKGERRRGKGHDGLY

QGLSTATKDTYDALHMQALPPR**

CD8/CD28/4-1BB/CD3z sequence:
(DNA)

(SEQ ID NO: 598)
acgacaaccccggcccc agaccaccaacgccagcccccaccatcgccagccaaccc ctgtctctga gaccagaagcctgtaggcctgccgccggtggagctgtgcacacaagaggactggatttcgcctgtga tatctacatttgggccccgctcgcaggcacatgtggagtgctcctcctctccctggtgattaccctg tactgcagaagcaagcggtctcggctcctgcattctgattacatgaacatgacccc aagaagaccag gccccaccaggaaacattaccagccctacgctccgccacgcgacttcgctgcctaccggtccaaaag gggccgcaaaaaactcctttacatttttaagcagccttttatgaggccagtacagacgactcaagag gaagacgggtgctcatgccgctttcctgaggaggaggaaggagggtgcgaactgcgcgttaagttct cccgatcagccgacgcgcctgcttacaagcagggccagaaccaactgtacaacgagctgaatctcgg -continued

```
tagacgggaagagtacgacgtgttggacaaacggagaggccgcgacccagaaatgggcggcaagcct cgcaggaaaaaccccccaggagggactgtacaatgagttgcagaaagataagatggcagaagcttata gcgagatcggaatgaaggggaaggagacgagggaaggacacgacggcctttatcagggcctgtc cacagcaacaaaagatacgtatgacgccctccatatgcaggcacttccaccacggtgataa
```

(amino acids)

(SEQ ID NO: 599)

TTTPAPRPPTPAPTIASQPLSLRPEACRPAAGGAVHTRGLDFACDIYIWAPLAGTCGVLLLSLVITL

YCRSKRSRLLHSDYMNMTPRRPGPTRKHYQPYAPPRDFAAYRSKRGRKKLLYIFKQPFMRPVQTTQE

EDGCSCRFPEEEEGGCELRVKFSRSADAPAYKQGQNQLYNELNLGRREEYDVLDKRRGRDPEMGGKP

RRKNPQEGLYNELQKDKMAEAYSEIGMKGERRRGKGHDGLYQGLSTATKDTYDALHMQALPPR**

CAR-T C3 4-1BB/CD3z sequence:
(DNA)

(SEQ ID NO: 600)

```
atggccctgccgtgaccgctttgctgctccccctggcgctgctgctgcacgccgccaggccacagg ttcagctggtgcagtctggagctgaggtgaagaagcctggggcctcagtgaaggtctcctgcaaggc ttctggttacacctttaccgactacgccatgaactgggtgcgacaggcccctggacaagggcttgag tggatgggagtgatcagcaccttcagcggtaacacaaacttcaaccagaagttcaagggcagagtca ccatgaccacagacacatccacgagcacagcctacatggagctgaggagcctgagatctgacgacac ggccgtgtattactgtgcgagaagcgactactacggcccatacttcgactactggggccagggcacc accctgaccgtgtccagcggcggtggcggatccggcggtggcggatccggcggtggcggatccgata ttgtgatgacccagactccactctctctgtccgtcacccctggacagccggcctccatctcctgcag gtctagtcagaccattgtccatagtaatggaaacacctatttggagtggtacctgcagaagccaggc cagtctccacagctcctgatctataaggtttccaaccggttctctggagtgccagataggttcagtg gcagcgggtcagggacagatttcacactgaaaatcagccgggtggaggctgaggatgttggggttta ttactgcttccaaggtagccacgtgccttttaccttcggcggagggaccaaggtggagatcaaacga actacgacaaccccggccccagaccaccaacgccagcccccaccatcgccagccaaccctgtctc tgagaccagaagcctgtaggcctgccgccggtggagctgtgcacacaagaggactggatttcgcctg tgatatctacatttgggccccgctcgcaggcacatgtggagtgctcctcctctcctggtgattacc ctgtactgcaaaaggggccgcaaaaaactcctttacatttttaagcagccttttatgaggccagtac agacgactcaagaggaagacggtgctcatgccgctttcctgaggaggaggaaggagggtgcgaact gcgcgttaagttctcccgatcagccgacgcgcctgcttacaagcagggccagaaccaactgtacaac gagctgaatctcggtagacgggaagagtacgacgtgttggacaaacggagaggccgcgacccagaaa tgggcggcaagcctcgcaggaaaaaccccaggagggactgtacaatgagttgcagaaagataagat ggcagaagcttatagcgagatcggaatgaaggggaaggagacgagggaaggacacgacggcctt tatcagggcctgtccacagcaacaaaagatacgtatgacgccctccatatgcaggcacttccaccac ggtgataa
```

(amino acids)

(SEQ ID NO: 601)

QVQLVQSGAEVKKPGASVKVSCKASGYTFTDYAMNWVRQAPGQGLEWMGVISTFSGNTNFNQKFKGR

VTMTTDTSTSTAYMELRSLRSDDTAVYYCARSDYYGPYFDYWGQGTTLTVSSGGGGSGGGGSGGGGS

DIVMTQTPLSLSVTPGQPASISCRSSQTIVHSNGNTYLEWYLQKPGQSPQLLIYKVSNRFSGVPDRF

SGSGSGTDFTLKISRVEAEDVGVYYCFQGSHVPFTFGGGTKVEIKRTTTTPAPRPPTPAPTIASQPL

SLRPEACRPAAGGAVHTRGLDFACDIYIWAPLAGTCGVLLLSLVITLYCKRGRKKLLYIFKQPFMRP

VQTTQEEDGCSCRFPEEEEGGCELRVKFSRSADAPAYKQGQNQLYNELNLGRREEYDVLDKRRGRDP

EMGGKPRRKNPQEGLYNELQKDKMAEAYSEIGMKGERRRGKGHDGLYQGLSTATKDTYDALHMQALP

PR**

C3 CAR gBLOCK 1 sequence:
(DNA)

(SEQ ID NO: 602)

atccacgctgttttgacctccatagaagattctagagctagctgtagagcttggtaccgagggccac catggccctgcccgtgaccgctttgctgctccccctggcgctgctgctgcacgccgccaggccacag gttcagctggtgcagtctggagctgaggtgaagaagcctggggcctcagtgaaggtctcctgcaagg cttctggttacacctttaccgactacgccatgaactgggtgcgacaggcccctggacaagggcttga gtggatgggagtgatcagcaccttcagcggtaacacaaacttcaaccagaagttcaagggcagagtc accatgaccacagacacatccacgagcacagcctacatggagctgaggagcctgagatctgacgaca cggccgtgtattactgtgcgagaagcgactactacggcccatacttcgactactggggccagggcac caccctgaccgtgtccagcggcggtggcggatccggcggtggcggatccggcggtggcggatccgat attgtgatgacccagactccactctctctgt C3 CAR gBLOCK 2 sequence:
(DNA)

(SEQ ID NO: 603)

tattgtgatgacccagactccactctctctgtccgtcacccctggacagccggcctccatctcctgc aggtctagtcagaccattgtccatagtaatggaaacacctatttggagtggtacctgcagaagccag gccagtctccacagctcctgatctataaggtttccaaccggttctctggagtgccagataggttcag tggcagcgggtcagggacagatttcacactgaaaatcagccgggtggaggctgaggatgttggggtt tattactgcttccaaggtagccacgtgccttttcaccttcggcggagggaccaaggtggagatcaaac gaactacgacaaccccggcccccagaccaccaacgccagcccccaccatcgccagccaacccctgtc tctgagaccagaagcctgtaggcctgccgccggtggagctgtgcacacaagaggactggatttcgcc tgtgatatctacatttgggccccgctcgcaggcacatgtg E6 scFV gBLOCK 1 sequence:
(DNA)

(SEQ ID NO: 604)

tgctctgggttccaggttccactggtgacgcggcccagccggccgaggtgcagctggtggagtctgg gggaggcctggtcaagcctggggggtccctgagactctcctgtgcagcctctggattcaccttcagt aggtatggcatgagctgggtccgccaggctccagggaagaggctggagtgggtctcaaccattagtg gcggaggcacctacatatactacccagactcagtgaagggccgattcaccatctccagagacaacgc caagaacaccctgtatctgcaaatgaacagcctgagagccgaggacacggctgtgtattactgtacc agagataactatggccgcaactatgattatggcatggattattggggccagggcaccctggtgaccg tgagcagcggcggtggcggatccggcggtggcggatccggcggtggcggatcc E6 scFV gBLOCK 2 sequence:
(DNA)

(SEQ ID NO: 605)

ggcggtggcggatccggcggtggcggatccggcggtggcggatccgaaattgtgttgacacagtctc cagccaccctgtctttgtctccaggggaaagagccaccctcacctgcagcgccaccagcagtgttag ctacatccactggtaccaacagaggcctggccagagccccaggctcctcatctatagcacctccaac ctggccagcggcatcccagccaggttcagtggcagtgggtctgggagcgactacactctcaccatca gcagcctagagcctgaagattttgcagtttattactgtcagcagcgtagcagctccccttttccactt tggcagcggcaccaaagtggaaattaaaaccggtcatcatcaccatcaccactgataagtttaaacc cgctgatcagcctcgactgtgccttctagt CAR-T C2 CD3z sequence:
(DNA)

(SEQ ID NO: 606)
atggccttgccagtgacggccctgctgctgccattggctcttctgttgcacgctgccaggcctgaagtgcagc tcgtagagagtggcggggggactggtgaagcccggtggaagcctcagactcagttgcgccgcctcaggtttcac tttttcaggttacgccatgtcctgggtaagacaggcaccggggaaaggactcgagtgggtgtctactatcagc tcaggaggcacttatatatattatcctgactctgtaaaaggccgatttacgatttctcgcgacaatgcaaaga actccctctacctccaaatgaacagtcttagggcagaagacactgctgtatactattgtgcacgcctcggcgg cgacaactactacgagtactttgacgtgtggggaaagggactaccgtgacagtttcaagcggaggaggtggc tcaggtggaggcgggtcaggggggggaggaagtgatattgtgctcacacaatccccagcctccctggctgtgt ctcccggccaacgcgctacaattacatgtcgggcctccaaaagcgtgagcaccagcggctacagctacatgca ctggtatcaacagaaaccaggacaaccccccaaactgttgatttatctcgcttcaaacttggagtccggcgtg cctgcgcgcttttcagggagtgggagcggcacagattttacgctgactatcaaccccgtagaagcaaacgata cagcgaattattattgtcaacattcccgggaactccccttttacgttcggcggggggcacaaaggtcgaaattaa gagaaccacgacaaccccggccccagaccaccaacgccagcccccaccatcgccagccaacccctgtctctg agaccagaagcctgtaggcctgccgccggtggagctgtgcacacaagaggactggatttcgcctgtgatatct acatttgggccccgctcgcaggcacatgtggagtgctcctcctctccctggtgattaccctgtactgccgcgt taagttctcccgatcagccgacgcgcctgcttacaagcagggccagaaccaactgtacaacgagctgaatctc ggtagacgggaagagtacgacgtgttggacaaacggagaggccgcgacccagaaatgggcggcaagcctcgca ggaaaaaccccaggagggactgtacaatgagttgcagaaagataagatggcagaagcttatagcgagatcgg aatgaaggggaaaggagacgagggaaaggacacgacggcctttatcagggcctgtccacagcaacaaagat acgtatgacgccctccatatgcaggcacttccaccacggtgataa (amino acids)

(SEQ ID NO: 607)
MALPVTALLLPLALLLHAARPEVQLVESGGGLVKPGGSLRLSCAASGFTFSGYAMSWVRQAPGKGLE

WVSTISSGGTYIYYPDSVKGRFTISRDNAKNSLYLQMNSLRAEDTAVYYCARLGGDNYYEYFDVWGK

GTTVTVSSGGGGSGGGGSGGGGSDIVLTQSPASLAVSPGQRATITCRASKSVSTSGYSYMHWYQQKP

GQPPKLLIYLASNLESGVPARFSGSGSGTDFTLTINPVEANDTANYYCQHSRELPFTFGGGTKVEIK

RTTTTPAPRPPTPAPTIASQPLSLRPEACRPAAGGAVHTRGLDFACDIYIWAPLAGTCGVLLLSLVI

TLYCRVKFSRSADAPAYKQGQNQLYNELNLGRREEYDVLDKRRGRDPEMGGKPRRKNPQEGLYNELQ

KDKMAEAYSEIGMKGERRRGKGHDGLYQGLSTATKDTYDALHMQALPPR**

CAR-T C2 CD28/CD3z sequence:
(DNA)

(SEQ ID NO: 608)
atggccttgccagtgacggccctgctgctgccattggctcttctgttgcacgctgccaggcctgaagtgcagc tcgtagagagtggcggggggactggtgaagcccggtggaagcctcagactcagttgcgccgcctcaggtttcac tttttcaggttacgccatgtcctgggtaagacaggcaccggggaaaggactcgagtgggtgtctactatcagc tcaggaggcacttatatatattatcctgactctgtaaaaggccgatttacgatttctcgcgacaatgcaaaga actccctctacctccaaatgaacagtcttagggcagaagacactgctgtatactattgtgcacgcctcggcgg cgacaactactacgagtactttgacgtgtggggaaagggactaccgtgacagtttcaagcggaggaggtggc tcaggtggaggcgggtcaggggggggaggaagtgatattgtgctcacacaatccccagcctccctggctgtgt ctcccggccaacgcgctacaattacatgtcgggcctccaaaagcgtgagcaccagcggctacagctacatgca ctggtatcaacagaaaccaggacaaccccccaaactgttgatttatctcgcttcaaacttggagtccggcgtg cctgcgcgcttttcagggagtgggagcggcacagattttacgctgactatcaaccccgtagaagcaaacgata -continued cagcgaattattattgtcaacattcccgggaactccccttacgttcggcgggggcacaaaggtcgaaattaa gagaaccacgacaaccccggccccagaccaccaacgccagcccccaccatcgccagccaacccctgtctctg agaccagaagcctgtaggcctgccgccggtggagctgtgcacacaagaggactggatttcgcctgtgatatct acatttgggccccgctcgcaggcacatgtggagtgctcctcctctccctggtgattaccctgtactgcagaag caagcggtctcggctcctgcattctgattacatgaacatgacccaagaagaccaggccccaccaggaaacat taccagccctacgctccgccacgcgacttcgctgcctaccggtcccgcgttaagttctcccgatcagccgacg cgcctgcttacaagcagggccagaaccaactgtacaacgagctgaatctcggtagacgggaagagtacgacgt gttggacaaacggagaggccgcgacccagaaatgggcggcaagcctcgcaggaaaaaccccaggagggactg tacaatgagttgcagaaagataagatggcagaagcttatagcgagatcggaatgaaggggaaaggagacgag ggaaaggacacgacggcctttatcagggcctgtccacagcaacaaaagatacgtatgacgccctccatatgca ggcacttccaccacggtgataa (amino acids)

(SEQ ID NO: 609)
MALPVTALLLPLALLLHAARPEVQLVESGGGLVKPGGSLRLSCAASGFTFSGYAMSWVRQAPGKGLE

WVSTISSGGTYIYYPDSVKGRFTISRDNAKNSLYLQMNSLRAEDTAVYYCARLGGDNYYEYFDVWGK

GTTVTVSSGGGGSGGGGSGGGGSDIVLTQSPASLAVSPGQRATITCRASKSVSTSGYSYMHWYQQKP

GQPPKLLIYLASNLESGVPARFSGSGSGTDFTLTINPVEANDTANYYCQHSRELPFTFGGGTKVEIK

RTTTTPAPRPPTPAPTIASQPLSLRPEACRPAAGGAVHTRGLDFACDIYIWAPLAGTCGVLLLSLVI

TLYCRSKRSRLLHSDYMNMTPRRPGPTRKHYQPYAPPRDFAAYRSRVKFSRSADAPAYKQGQNQLYN

ELNLGRREEYDVLDKRRGRDPEMGGKPRRKNPQEGLYNELQKDKMAEAYSEIGMKGERRRGKGHDGL

YQGLSTATKDTYDALHMQALPPR**

CAR-T C2 4-1BB/CD3z sequence:
(DNA)

(SEQ ID NO: 610)
atggccttgccagtgacggccctgctgctgccattggctcttctgttgcacgctgccaggcctgaagtgcagc tcgtagagagtggcgggggactggtgaagcccgtggaagcctcagactcagttgcgccgcctcaggtttcac tttttcaggttacgccatgtcctgggtaagacaggcaccggggaaaggactcgagtgggtgtctactatcagc tcaggaggcacttatatatattatcctgactctgtaaaaggccgatttacgatttctcgcgacaatgcaaaga actccctctacctccaaatgaacagtcttagggcagaagacactgctgtatactattgtgcacgcctcggcgg cgacaactactacgagtactttgacgtgtggggaaagggactaccgtgacagtttcaagcggaggaggtggc tcaggtggaggcgggtcagggggggaggaagtgatattgtgctcacacaatcccagcctccctggctgtgt ctcccggccaacgcgctacaattacatgtcgggcctccaaaagcgtgagcaccagcggctacagctacatgca ctggtatcaacagaaaccaggacaacccccaaactgttgatttatctcgcttcaaacttggagtccggcgtg cctgcgcgcttttcagggagtgggagcggcacagattttacgctgactatcaaccccgtagaagcaaacgata cagcgaattattattgtcaacattcccgggaactccccttacgttcggcgggggcacaaaggtcgaaattaa gagaaccacgacaaccccggccccagaccaccaacgccagcccccaccatcgccagccaacccctgtctctg agaccagaagcctgtaggcctgccgccggtggagctgtgcacacaagaggactggatttcgcctgtgatatct acatttgggccccgctcgcaggcacatgtggagtgctcctcctctccctggtgattaccctgtactgcaaaag gggccgcaaaaaactccttacattttaagcagccttttatgaggccagtacagacgactcaagaggaagac gggtgctcatgccgctttcctgaggaggaggaaggagggtgcgaactgcgcgttaagttctcccgatcagccg acgcgcctgcttacaagcagggccagaaccaactgtacaacgagctgaatctcggtagacgggaagagtacga cgtgttggacaaacggagaggccgcgacccagaaatgggcggcaagcctcgcaggaaaaaccccaggaggga ctgtacaatgagttgcagaaagataagatggcagaagcttatagcgagatcggaatgaagggggaaaggagac -continued gagggaaaggacacgacggcctttatcagggcctgtccacagcaacaaaagatacgtatgacgccctccatat gcaggcacttccaccacggtgataa (amino acids)

(SEQ ID NO: 611)

MALPVTALLLPLALLLHAARPEVQLVESGGGLVKPGGSLRLSCAASGFTFSGYAMSWVRQAPGKGLE

WVSTISSGGTYIYYPDSVKGRFTISRDNAKNSLYLQMNSLRAEDTAVYYCARLGGDNYYEYFDVWGK

GTTVTVSSGGGGSGGGGSGGGGSDIVLTQSPASLAVSPGQRATITCRASKSVSTSGYSYMHWYQQKP

GQPPKLLIYLASNLESGVPARFSGSGSGTDFTLTINPVEANDTANYYCQHSRELPFTFGGGTKVEIK

RTTTTPAPRPPTPAPTIASQPLSLRPEACRPAAGGAVHTRGLDFACDIYIWAPLAGTCGVLLLSLVI

TLYCKRGRKKLLYIFKQPFMRPVQTTQEEDGCSCRFPEEEEGGCELRVKFSRSADAPAYKQGQNQLY

NELNLGRREEYDVLDKRRGRDPEMGGKPRRKNPQEGLYNELQKDKMAEAYSEIGMKGERRRGKGHDG

LYQGLSTATKDTYDALHMQALPPR**

CAR-T C2 OX40/CD3z sequence:
(DNA)

(SEQ ID NO: 612)

atggccttgccagtgacggccctgctgctgccattggctcttctgttgcacgctgccaggcctgaagtgcagc tcgtagagagtggcggggactggtgaagcccggtggaagcctcagactcagttgcgccgcctcaggtttcac tttttcaggttacgccatgtcctgggtaagacaggcaccggggaaaggactcgagtgggtgtctactatcagc tcaggaggcacttatatatattatcctgactctgtaaaaggccgatttacgatttctcgcgacaatgcaaaga actccctctacctccaaatgaacagtcttagggcagaagacactgctgtatactattgtgcacgcctcggcgg cgacaactactacgagtactttgacgtgtggggaaagggactaccgtgacagtttcaagcggaggaggtggc tcaggtggaggcgggtcaggggggggaggaagtgatattgtgctcacacaatccccagcctccctggctgtgt ctcccggccaacgcgctacaattacatgtcgggcctccaaaagcgtgagcaccagcggctacagctacatgca ctggtatcaacagaaaccaggacaaccccccaaactgttgatttatctcgcttcaaacttggagtccggcgtg cctgcgcgcttttcagggagtgggagcggcacagattttacgctgactatcaaccccgtagaagcaaacgata cagcgaattattattgtcaacattcccgggaactccccttttacgttcggcggggggacaaaggtcgaaattaa gagaaccacgacaaccccggccccagaccaccaacgccagcccccaccatcgccagccaacccctgtctctg agaccagaagcctgtaggcctgccgccggtggagctgtgcacacaagaggactggatttcgcctgtgatatct acatttgggccccgctcgcaggcacatgtggagtgctcctcctctcgctggtgattaccctgtactgccggag ggaccagaggctgccccccgatgcccacaagccccctgggggaggcagtttccggaccccccatccaagaggag caggccgacgcccactccaccctggccaagatccgcgttaagttctcccgatcagccgacgcgcctgcttaca agcagggccagaaccaactgtacaacgagctgaatctcggtagacgggaagagtacgacgtgttggacaaacg gagaggccgcgacccagaaatgggcggcaagcctcgcaggaaaaaccccaggagggactgtacaatgagttg cagaaagataagatggcagaagcttatagcgagatcggaatgaaggggggaaaggagacgagggaaaggacacg acggcctttatcagggcctgtccacagcaacaaaagatacgtatgacgccctccatatgcaggcacttccacc acggtgataa (amino acids)

(SEQ ID NO: 613)

MALPVTALLLPLALLLHAARPEVQLVESGGGLVKPGGSLRLSCAASGFTFSGYAMSWVRQAPGKGLE

WVSTISSGGTYIYYPDSVKGRFTISRDNAKNSLYLQMNSLRAEDTAVYYCARLGGDNYYEYFDVWGK

GTTVTVSSGGGGSGGGGSGGGGSDIVLTQSPASLAVSPGQRATITCRASKSVSTSGYSYMHWYQQKP

GQPPKLLIYLASNLESGVPARFSGSGSGTDFTLTINPVEANDTANYYCQHSRELPFTFGGGTKVEIK

RTTTTPAPRPPTPAPTIASQPLSLRPEACRPAAGGAVHTRGLDFACDIYIWAPLAGTCGVLLLSLVI

TLYCRRDQRLPPDAHKPPGGGSFRTPIQEEQADAHSTLAKIRVKFSRSADAPAYKQGQNQLYNELNL

-continued

GRREEYDVLDKRRGRDPEMGGKPRRKNPQEGLYNELQKDKMAEAYSEIGMKGERRRGKGHDGLYQGL

STATKDTYDALHMQALPPR**

CAR-T C2 CD28/OX40/CD3z sequence:
(DNA)
(SEQ ID NO: 614)
atggccttgccagtgacggccctgctgctgccattggctcttctgttgcacgctgccaggcctgaagtgcagc tcgtagagagtggcgggggactggtgaagcccggtggaagcctcagactcagttgcgccgcctcaggtttcac tttttcaggttacgccatgtcctgggtaagacaggcaccggggaaaggactcgagtgggtgtctactatcagc tcaggaggcacttatatatattatcctgactctgtaaaaggccgatttacgatttctcgcgacaatgcaaaga actccctctacctccaaatgaacagtcttagggcagaagacactgctgtatactattgtgcacgcctcggcgg cgacaactactacgagtactttgacgtgtggggaaagggactaccgtgacagtttcaagcggaggaggtggc tcaggtggaggcgggtcaggggggggaggaagtgatattgtgctcacacaatccccagcctccctggctgtgt ctcccggccaacgcgctacaattacatgtcgggcctccaaaagcgtgagcaccagcggctacagctacatgca ctggtatcaacagaaaccaggacaaccccccaaactgttgatttatctcgcttcaaacttggagtccggcgtg cctgcgcgcttttcagggagtgggagcggcacagattttacgctgactatcaaccccgtagaagcaaacgata cagcgaattattattgtcaacattcccgggaactccccttttacgttcggcggggggcacaaaggtcgaaattaa gagaaccacgacaaccccggcccccagaccaccaacgccagcccccaccatcgccagccaacccctgtctctg agaccagaagcctgtaggcctgccgccggtggagctgtgcacacaagaggactggatttcgcctgtgatatct acatttgggccccgctcgcaggcacatgtggagtgctcctcctctccctggtgattaccctgtactgcagaag caagcggtctcggctcctgcattctgattacatgaacatgaccccaagaagaccaggccccaccaggaaacat taccagccctacgctccgccacgcgacttcgctgcctaccggtcccggagggaccagaggctgcccccgatg cccacaagcccctggggaggcagtttccggaccccatccaagaggagcaggccgacgcccactccaccct ggccaagatccgcgttaagttctcccgatcagccgacgcgcctgcttacaagcagggccagaaccaactgtac aacgagctgaatctcggtagacgggaagagtacgacgtgttggacaaacggagaggccgcgacccagaaatgg gcggcaagcctcgcaggaaaaaccccaggagggactgtacaatgagttgcagaaagataagatggcagaagc ttatagcgagatcggaatgaagggggaaggagacgagggaaaggacacgacggcctttatcagggcctgtcc acagcaacaaaagatacgtatgacgccctccatatgcaggcacttccaccacggtgataa (amino acids)
(SEQ ID NO: 615)
MALPVTALLLPLALLLHAARPEVQLVESGGGLVKPGGSLRLSCAASGFTFSGYAMSWVRQAPGKGLE

WVSTISSGGTYIYYPDSVKGRFTISRDNAKNSLYLQMNSLRAEDTAVYYCARLGGDNYYEYFDVWGK

GTTVTVSSGGGGSGGGGSGGGGSDIVLTQSPASLAVSPGQRATITCRASKSVSTSGYSYMHWYQQKP

GQPPKLLIYLASNLESGVPARFSGSGSGTDFTLTINPVEANDTANYYCQHSRELPFTFGGGTKVEIK

RTTTTPAPRPPTPAPTIASQPLSLRPEACRPAAGGAVHTRGLDFACDIYIWAPLAGTCGVLLLSLVI

TLYCRSKRSRLLHSDYMNMTPRRPGPTRKHYQPYAPPRDFAAYRSRRDQRLPPDAHKPPGGGSFRTP

IQEEQADAHSTLAKIRVKFSRSADAPAYKQGQNQLYNELNLGRREEYDVLDKRRGRDPEMGGKPRRK

NPQEGLYNELQKDKMAEAYSEIGMKGERRRGKGHDGLYQGLSTATKDTYDALHMQALPPR**

CAR-T E6 OX40/CD3z sequence:
(DNA)
(SEQ ID NO: 616)
atggccctgccgtgaccgctttgctgctcccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccggggggggcacttacatctattaccccgactcagtcaaggggagattta ccatttcacgagacaacgctaagaataccctgtatttgcagatgaattctctgagagcagaggacac -continued

```
agctgtttactattgtacccgcgacaactatggcaggaactacgactacggtatggactattgggga caagggacattggttacagtgagcagtggcggcggggcagcggaggaggaggcagcggtgggggg gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaaacgacaaccccg gcccccagaccaccaacgccagcccccaccatcgccagccaacccctgtctctgagaccagaagcct gtaggcctgccgccggtggagctgtgcacacaagaggactggatttcgcctgtgatatctacatttg ggccccgctcgcaggcacatgtggagtgctcctcctctccctggtgattaccctgtactgccggagg gaccagaggctgccccccgatgcccacaagccccctgggggaggcagtttccggaccccatccaag aggagcaggccgacgcccactccaccctggccaagatccgcgttaagttctcccgatcagccgacgc gcctgcttacaagcagggccagaaccaactgtacaacgagctgaatctcggtagacgggaagagtac gacgtgttggacaaacggagaggccgcgacccagaaatgggcggcaagcctcgcaggaaaaaccccc aggagggactgtacaatgagttgcagaaagataagatggcagaagcttatagcgagatcggaatgaa gggggaaaggagacgagggaaaggacacgacggcctttatcagggcctgtccacagcaacaaaagat acgtatgacgccctccatatgcaggcacttccaccacggtgataa
```

(amino acids)

(SEQ ID NO: 617)

```
MALPVTALLLPLALLLHAARPEVQLVESGGGLVKPGGSLRLSCAASGFTFSRYGMSWVRQAPGKRLE

WVSTISGGGTYIYYPDSVKGRFTISRDNAKNTLYLQMNSLRAEDTAVYYCTRDNYGRNYDYGMDYWG

QGTLVTVSSGGGGSGGGGSGGGGSEIVLTQSPATLSLSPGERATLTCSATSSVSYIHWYQQRPGQSP

RLLIYSTSNLASGIPARFSGSGSGSDYTLTISSLEPEDFAVYYCQQRSSSPFTFGSGTKVEIKTTTP

APRPPTPAPTIASQPLSLRPEACRPAAGGAVHTRGLDFACDIYIWAPLAGTCGVLLLSLVITLYCRR

DQRLPPDAHKPPGGGSFRTPIQEEQADAHSTLAKIRVKFSRSADAPAYKQGQNQLYNELNLGRREEY

DVLDKRRGRDPEMGGKPRRKNPQEGLYNELQKDKMAEAYSEIGMKGERRRGKGHDGLYQGLSTATKD

TYDALHMQALPPR**
```

CAR-T E6 CD28/OX40/CD3z sequence:
(DNA)

(SEQ ID NO: 618)

```
atggccctgccgtgaccgctttgctgctcccctggcgctgctgctgcacgccgccaggccagagg tccagctggttgagagtggcggtgggctggttaagcctggcggctccctgcggctgagctgcgccgc gagtggatttactttcagccgatatgggatgagttgggtgcggcaagctcccgggaagaggctggaa tgggtctcaacaatctccgggggggcacttacatctattaccccgactcagtcaaggggagattta ccatttcacgagacaacgctaagaatacctgtatttgcagatgaattctctgagagcagaggacac agctgtttactattgtacccgcgacaactatggcaggaactacgactacggtatggactattgggga caagggacattggttacagtgagcagtggcggcggggcagcggaggaggaggcagcggtgggggg gcagcgagatagtgctcacgcagtcacccgcgactctcagtctctcacctggggaacgagctaccct gacgtgctctgctacctcctcagtgtcatatattcactggtatcagcaacggcccgggcagtcccct agattgctcatttatagtacctctaatctggcctcaggtatccctgcacgattttctggatctggtt caggttctgattacaccctcactatctctagcctggagcctgaagactttgccgtttattactgcca gcagaggtctagctccccattcacctttgggagtgggaccaaggttgaaattaaaacgacaaccccg gcccccagaccaccaacgccagcccccaccatcgccagccaacccctgtctctgagaccagaagcct
```

-continued

```
gtaggcctgccgccggtggagctgtgcacacaagaggactggatttcgcctgtgatatctacatttg
ggccccgctcgcaggcacatgtggagtgctcctcctctccctggtgattaccctgtactgcagaagc
aagcggtctcggctcctgcattctgattacatgaacatgaccccaagaagaccaggccccaccagga
aacattaccagcccacgctccgccacgcgacttcgctgcctaccggtcccggagggaccagaggct
gcccccgatgcccacaagccccctggggaggcagtttccggaccccatccaagaggagcaggcc
gacgcccactccaccctggccaagatccgcgttaagttctcccgatcagccgacgcgcctgcttaca
agcagggccagaaccaactgtacaacgagctgaatctcggtagacgggaagagtacgacgtgttgga
caaacgagaggccgcgacccagaaatgggcggcaagcctcgcaggaaaaacccccaggagggactg
tacaatgagttgcagaaagataagatggcagaagcttatagcgagatcggaatgaaggggaagga
gacgagggaaaggacacgacggcctttatcagggcctgtccacagcaacaaaagatacgtatgacgc
cctccatatgcaggcacttccaccacggtgataa
```

(amino acids)
(SEQ ID NO: 619)
MALPVTALLLPLALLLHAARPEVQLVESGGGLVKPGGSLRLSCAASGFTFSRYGMSWVRQAPGKRLE
WVSTISGGGTYIYYPDSVKGRFTISRDNAKNTLYLQMNSLRAEDTAVYYCTRDNYGRNYDYGMDYWG
QGTLVTVSSGGGGSGGGGSGGGGSEIVLTQSPATLSLSPGERATLTCSATSSVSYIHWYQQRPGQSP
RLLIYSTSNLASGIPARFSGSGSGSDYTLTISSLEPEDFAVYYCQQRSSSPFTFGSGTKVEIKTTTP
APRPPTPAPTIASQPLSLRPEACRPAAGGAVHTRGLDFACDIYIWAPLAGTCGVLLLSLVITLYCRS
KRSRLLHSDYMNMTPRRPGPTRKHYQPYAPPRDFAAYRSRRDQRLPPDAHKPPGGGSFRTPIQEEQA
DAHSTLAKIRVKFSRSADAPAYKQGQNQLYNELNLGRREEYDVLDKRRGRDPEMGGKPRRKNPQEGL
YNELQKDKMAEAYSEIGMKGERRRGKGHDGLYQGLSTATKDTYDALHMQALPPR**

MUC1 truncated cytoplasmic sequence
(amino acids)
(SEQ ID NO: 620)
SNIKFRPGSVVVQLTLAFREGTINVHDVETQFNQYKTEAASRY MUC1 truncated cytoplasmic sequence
(amino acids)
(SEQ ID NO: 621)
SVVVQLTLAFREGTINVHDVETQFNQYKTEAASRY MUC1 truncated cytoplasmic sequence
(amino acids)
(SEQ ID NO: 622)
LTLAFREGTINVHDVETQFNQY MUC1 truncated cytoplasmic sequence
(amino acids)
(SEQ ID NO: 623)
SNIKFRPGSVVVQLTLAFREGTIN Primers
(SEQ ID NO: 624)
attctaagcttgggccaccatggaactg (SEQ ID NO: 625)
tctagagtttaaacttactatttacccggagacagggagag (SEQ ID NO: 626)
agtatggcccagccggccgaggtgcagctggtggagtctgg (SEQ ID NO: 627)
tagaaggcacagtcgaggctgatcag (SEQ ID NO: 628)
attctaagcttgggccaccatggaagc (SEQ ID NO: 629)
tctagagtttaaacttactaacactctcccctgttgaagc

```
agtatggcccagccggccgaaattgtgttgacacagtctccag                 (SEQ ID NO: 630)

tagaaggcacagtcgaggctgatcag                                  (SEQ ID NO: 631)

actgtcatatggaggtgcagctggtggagtctg                           (SEQ ID NO: 632)

actgtctcgagtttaatttccactttggtgccgctgc                       (SEQ ID NO: 633)

actgtcatatggaggtgcagctggtggagtctg                           (SEQ ID NO: 634)

actgtaccggttttaatttccactttggtgccgctgc                       (SEQ ID NO: 635)

cttcttcctcaggagcaagctcaccgtgg                               (SEQ ID NO: 636)

gagccgtcggagtccagc                                          (SEQ ID NO: 637)

gcacctgaactcctgggg                                          (SEQ ID NO: 638)

tttaatttccactttggtgccg                                      (SEQ ID NO: 639)

cgcggctagcttaagcttggtaccgagggcca                            (SEQ ID NO: 640)

cgcggcggccgcctgatcagcgggtttaaacttatc                        (SEQ ID NO: 641)
```

The present invention is not to be limited in scope by the specific embodiments described herein. Indeed, various modifications of the invention in addition to those described herein will become apparent to those skilled in the art from the foregoing description and accompanying figures. Such modifications are intended to fall within the scope of the appended claims. The following examples are offered by way of illustration of the present invention, and not by way of limitation.

EXAMPLES

Example 1— ELISA Competition with NME1 and NME7

PSMGFR peptide was covalently coupled to BSA using Imject Maleimide activated BSA kit (Thermo Fisher). PSMGFR peptide coupled BSA was diluted to 7.5 ug/mL in 0.1M carbonate/bicarbonate buffer pH 9.6 and 50 uL was added to each well of a 96 well plate. After overnight incubation at 4° C., the plate was wash twice with PBS-T and a 3% BSA solution was added to block remaining binding site on the well. After 1h at RT the plate was washed twice with PBS-T and NME1or NME7, diluted in PBS-T+ 1% BSA, was added at saturating concentration. After 1h at RT the plate was washed 3× with PBS-T and anti-MUC1* antibody (or antibody fragments), diluted in PBS-T+1% BSA, was added (5x molar excess comapred to NME1/NME7). After 1h at RT the plate was washed 3× with PBS-T and goat anti HisTag-HRP, diluted in PBS-T+1% BSA, was added at 1/10000 dilution. After 1h at RT the plate was washed 3× with PBS-T and remaining NME1 or NME7 bound to the PSMGFR peptide was measured at 415 nm using a ABTS solution (Thermo Fisher).

Example 2-Humanization of Anti-MUC1* Extracellular Domain Monoclonal Antibodies

We generated humanized antibodies that bind to the extracellular domain of MUC1* by a process called complementarity determining region, 'CDR', grafting. First, homology searches were performed to independently align the heavy chain variable region and light chain variable region nucleotides sequences of mouse monoclonal anti-MUC1* antibody (E6 HC SEQ ID NOS:12-13; LC SEQ ID NOS:65-66 and MN-C2 HC SEQ ID NO:118-119; LC SEQ ID NO: 168-169) against a repertoire of human antibody sequences (IMGT, the international ImMunoGeneTics information system). The sequences with the highest homology were selected. IGHV3-21*01 is a human IgG heavy chain variable region sequence with 82.9% (DNA) and 74.5% (amino acids) identity to MouseMN-E6 heavy chain variable region. IGKV3-11*02 is a human IgG light chain variable region sequence with 68.8% (DNA) and 61.1% (amino acids) identity to MouseMN-E6 light chain variable region. IGHV3-21*04 is a human IgG heavy chain variable region sequence with 85% (DNA) and 81.6% (amino acids) identity to Mouse MN-C2 heavy chain variable region. IGKV7-3*01 is a human IgG light chain variable region sequence with 76.9% (DNA) and 71.3% (amino acids) identity to Mouse MN-C2 light chain variable region. Second, a model of the mouse scFv was generated to select and keep the mouse residues important for the stability of the CDR and framework. Finally, CDRs from the human germlines were replaced by the corresponding mouse CDRs.

Humanized MN-E6 IgG2 Heavy Chain Cloning

The Kozak consensus sequence followed by the IGHV3-21*03 leader sequence, the humanizedMN-E6 heavy chain variable region and the constant region of human IgG2 was synthesized by our request by GenScript, NJ (SEQ ID NOS:52-53. The cDNA was amplified by polymerase chain reaction (PCR) using the following primer: 5'-ATTCTAAGCTTGGGCCACCATGGAACTG-3' (SEQ ID NO:624) and 5'-TCTAGAGTTTAAACTTACTATTTACCCGGAGACAGGGAGAG-3' (SEQ ID NO:625). After digestion with HindIII and PmeI restriction enzymes (New England Biolabs), the purified fragment was cloned into the pCDNA 3.1 V5 vector (Life Technologies) digested with the same restriction enzymes.

Humanized MN-E6 heavy chain cDNA was amplified by polymerase chain reaction (PCR) using the following primer: 5'-AGTATGGCCCAGCCGGCCGAGGTGCAGCTGGTGGAGTCTGG-3' (SEQ ID NO:626) and 5'-TAGAAGGCACAGTCGAGGCTGATCAG-3' (SEQ ID NO:627). After digestion with SfiI and PmeI restriction enzymes (New England Biolabs), the purified fragment was cloned into the pSECTag2 vector (Life Technologies) digested with the same restriction enzymes.

Humanized MN-E6 Kappa Light Chain Cloning

The Kozak consensus sequence followed by the IGHV3-11*02 leader sequence, the humanizedMN-E6 light chain variable region and the constant region of human Kappa light chain was synthesized by our request by GenScript, NJ (SEQ ID NOS: 107-108). The cDNA was amplified by polymerase chain reaction (PCR) using the following primer: 5'-ATTCTAAGCTTGGGCCACCATGGAAGC-3' (SEQ ID NO:628) and 5'-TCTAGAGTTTAAACTTACTAACACTCTCCCCTGTTGAAGC-3' (SEQ ID NO:629). After digestion with HindIII and PmeI restriction enzymes (New England Biolabs), the purified fragment was cloned into the pCDNA 3.1 V5 vector (Life Technologies) digested with the same restriction enzymes.

HumanizedMN-E6 light chain cDNA was amplified by polymerase chain reaction (PCR) using the following primer: 5'-AGTATGGCCCAGCCGGCCGAAATTGTGTTGACACAGTCTCCAG-3' (SEQ ID NO:630) and 5'-TAGAAGGCACAGTCGAGGCTGATCAG-3' (SEQ ID NO:631). After digestion with SfiI and PmeI restriction enzymes (New England Biolabs), the purified fragment was cloned into the pSECTag2 vector (Life Technologies) digested with the same restriction enzymes.

Humanized MN-E6 IgG1 Heavy Chain Cloning

HumanizedMN-E6 IgG2 constructs (pCDNA 3.1 V5 and pSECTag2) were digested with BstEII and PmeI (New England Biolabs) to remove the IgG2 heavy chain constant region. The vector with humanizedMN-E6 heavy chain variable region was purified. Human IgG1 heavy chain constant region was synthesized by our request by IDT, IA (SEq ID NOS: 60-61). Both gBLOCKS and the purified vector with humanizedMN-E6 variable region were ligated using the Gibson assembly cloning kit (New England Biolabs).

HumanizedMN-E6 Lambda Light Chain Cloning

HumanizedMN-E6 kappa light chain constructs (pCDNA 3.1 V5 vector and pSECTag2 vector) were digested with KpnI and PmeI (New England Biolabs) to remove the kappa light chain constant region. The vector with humanizedMN-E6 light chain variable region was purified. Human lambda light chain constant region was synthesized by our request by IDT, IA (SEQ ID NO: 115). Both, gBLOCK and the purified vector with humanizedMN-E6 light chain variable region were ligated using the Gibson assembly cloning kit (New England Biolabs).

Humanized MN-C2 IgG1 and IgG2 Heavy Chain Cloning

HumanizedMN-E6 IgG1 and IgG2 heavy chain in pSECTag2 were digested with SfiI and AgeI to remove theMN-E6 variable region. HumanizedMN-E6 IgG1 and IgG2 heavy chain in pCDNA 3.1 V5 were digested with HindIII and AgeI to remove theMN-E6 variable region The vectors with human IgG1 or IgG2 constant region were purified. Humanized MN-C2 heavy chains were synthesized by our request by IDT, IA (SEQ ID NOS:160 and 165). Sequence to be cloned into pCDNA 3.1 V5 contains in 5' the murine Ig kappa chain leader sequence (SEQ ID NO 160). Both, gBLOCK and purified vector with human IgG1 or IgG2 constant region were ligated using the Gibson assembly cloning kit (New England Biolabs).

Humanized MN-C2 Kappa/Lambda Light Chain Cloning

Two humanized MN-C2 variable region fused to the kappa light chain constant region and two humanized MN-C2 variable region fused to the lambda light chain constant region were synthesized by our request by IDT, IA (SEQ ID NOS: 210 and 213 and SEQ ID NOS: 216 and 219, respectively). pCDNA 3.1 V5 was digested with HindIII and PmeI restriction enzymes (New England Biolabs) and pSEC Tag2 was digested with SfiI and PmeI restriction enzymes (New England Biolabs). Both plasmids were then purified. SEQ ID NOS: 210 and 216 were ligated into digested pCDNA 3.1 V5 and SEQ ID NOS: 213 and 219 were ligated into digested pSEC Tag2 using the Gibson assembly cloning kit (New England Biolabs).

Humanized C3 IgG1 Heavy Chain Cloning

Humanized E6 IgG1 construct (pSECTag2) was digested with SfiI and AgeI (New England Biolabs) to remove the E6 heavy chain variable region. The vector without humanized E6 heavy chain variable region was purified. Humanized C3 heavy chain variable region was synthesized by our request by IDT, IA (SEQ ID NO:457). gBLOCK and the purified vector were ligated using the Gibson assembly cloning kit (New England Biolabs).

Humanized C3 Kappa Light Chain Cloning pEF V5-His was digested with BamHI and PmeI (New England Biolabs) and purified. Humanized C3 kappa light chain was synthesized by our request by IDT, IA (SEq ID NO:504). Both, gBLOCK and the purified vector were ligated using the Gibson assembly cloning kit (New England Biolabs).

Humanized C8 Kappa Light Chain Cloning pEF V5-His was digested with BamHi and PmeI (New England Biolabs) and purified.

Humanized C8 kappa light chain was synthesized by our request by IDT, IA (SEq ID NO:583). Both, gBLOCK and the purified vector were ligated using the Gibson assembly cloning kit (New England Biolabs).

Example 3— Cloning of Humanized scFV of Anti-MUC1* Extracellular Domain Antibodies Humanized E6 scFV Cloning:

pSEC Tag2 was digested with SfiI and PmeI (New England Biolabs) and purified. Humanized E6 scFV gBLOCKS were synthesized by our request by IDT, IA (SEQ ID NOS: 604-605). Both, gBLOCKs and the purified vector were ligated using the Gibson assembly cloning kit (New England Biolabs).

Humanized E6 scFV cDNA was amplified by polymerase chain reaction (PCR) using the following primers: 5-ACTGTCATATGGAGGTGCAGCTGGTGGAGTCTG-3' (SEQ ID NO:632) and 5'-ACTGTCTCGAGTTTAATTTCCACTTTGGTGCCGCTGC-3' (SEQ ID NO:633). After digestion with NdeI and XhoI restriction enzymes (New England Biolabs), the purified fragment was cloned into the pET21b vector (Novagen) digested with the same restriction enzymes. Humanized E6 scFV cDNA was cloned 5' of the Histidine Tag for protein purification.

Humanized E6 scFV cDNA was amplified by polymerase chain reaction (PCR) using the following primers: 5-ACTGTCATATGGAGGTGCAGCTGGTGGAGTCTG-3' (SEQ ID NO:634) and 5'-ACTGTACCGGTTTTAAT-TTCCACTTTGGTGCCGCTGC-3' (SEQ ID NO:635). After digestion with NdeI and AgeI restriction enzymes (New England Biolabs), the purified fragment was cloned into a modified pET21b vector (Novagen) digested with the same restriction enzymes. The vector was modified to include the StrepTag2 sequence followed by 2 stop codons 5' of the Histidine Tag. Humanized E6 scFV cDNA was cloned 5' of the StrepTag2 for protein purification.

Humanized E6, C2, C3 and C8 scFV-Fc Cloning

Humanized E6 IgG1 construct (pSECTag2) was digested with SfiI and SacII (New England Biolabs) to remove the E6 heavy chain variable region and part of the IgG1 heavy chain constant region. The vector without humanized E6 heavy chain variable region was purified. Humanized E6, C2, C3 and C8 scFV gBLOCKS were synthesized by our request by IDT, IA (SEQ ID NO:258-259, 262-263, 266-267 and 270-271). E6, C2, C3 and C8 gBLOCKS and the purified vector were ligated using the Gibson assembly cloning kit (New England Biolabs) to assemble the corresponding scFV in frame of the human IgG1 Fc region.

Humanized E6 scFV-Fc Y407R Cloning

Humanized E6 scFV-Fc tyrosine 407 was mutated to an arginine (Y407R) by site directed mutagenesis. The Q5 site directed mutagenesis kit (NEB) was used with the following primers: 5'-CTTCTTCCTCAGGAGCAAGCT-CACCGTGG-3' (SEQ ID NO:636) and 5'-GAGCCGTCG-GAGTCCAGC-3' (SEQ ID NO:637)

Humanized E6 scFV-Fc Hingeless Cloning

Hinge region of humanized E6 scFV-Fc was removed by site directed mutagenesis. The Q5 site directed mutagenesis kit (NEB) was used with the following primers: 5'-GCACCTGAACTCCTGGGG-3' (SEQ ID NO:638) and 5'-TTTAATTTCCACTTTGGTGCCG-3' (SEQ ID NO:639)

Example 4— Cloning of CAR-T of Anti-MUC1* Extracellular Domain Antibodies

Car E6 Cd28/4-1Bb/Cd3z Cloning:

pCDNA 3.1 V5 was digested with KpnI and PmeI (New England Biolabs) and purified. Full CAR-T E6 (CD8/CD28/4-1BB/CD3z) gBLOCK was synthesized by our request by IDT, IA (SEq ID NO:305). Both, gBLOCK and the purified vector were ligated using the Gibson assembly cloning kit (New England Biolabs).

Car E6 Cd3z Cloning:

pCDNA 3.1 V5 CAR-T E6 CD8/CD28/4-1BB/CD3z was digested with EcoRV and PmeI (New England Biolabs) to remove cytoplasmic domains. The vector without cytoplasmic domains was purified. CAR-T E6 CD8/CD3z gBLOCK was synthesized by our request by IDT, IA (SEq ID NO:296). Both, gBLOCK and the purified vector were ligated using the Gibson assembly cloning kit (New England Biolabs).

Car E6 Cd28/Cd3z Cloning:

pCDNA 3.1 V5 CAR-T E6 CD8/CD28/4-1BB/CD3z was digested with EcoRV and PmeI (New England Biolabs) to remove cytoplasmic domains. The vector without cytoplasmic domains was purified. CAR-T E6 CD8/CD28/CD3z gBLOCK was synthesized by our request by IDT, IA (SEq ID NO:299). Both, gBLOCK and the purified vector were ligated using the Gibson assembly cloning kit (New England Biolabs).

Car E6 4-1Bb/Cd3z Cloning:

pCDNA 3.1 V5 CAR-T E6 CD8/CD28/4-1BB/CD3z was digested with EcoRV and PmeI (New England Biolabs) to remove cytoplasmic domains. The vector without cytoplasmic domains was purified. CAR-T E6 CD8/4-1BB/CD3z gBLOCK was synthesized by our request by IDT, IA (SEq ID NO:302). Both, gBLOCK and the purified vector were ligated using the Gibson assembly cloning kit (New England Biolabs).

Car C2 Cd28/4-1Bb/Cd3z Cloning:

pCDNA 3.1 V5 CAR-T E6 CD8/CD28/4-1BB/CD3z was digested with KpnI and EcoRV (New England Biolabs) E6 scFV. The vector without E6 scFV was purified. CAR-T C2 gBLOCKs were synthesized by our request by IDT, IA (SEq ID NOS: 308-309). Both, gBLOCKs and the purified vector were ligated using the Gibson assembly cloning kit (New England Biolabs).

CAR Sub-Cloning into Lentiviral Vectors:

All pcDNA 3.1 V5 CAR cDNAs were amplified by polymerase chain reaction (PCR) using the following primers: 5-CGCGGCTAGCT-TAAGCTTGGTACCGAGGGCCA-3' (SEQ ID NO:640) and 5'-CGCGGCGGCCGCCTGATCAGCGGGTT-TAAACTTATC-3' (SEQ ID NO:641).

After digestion with NheI and NotI restriction enzymes (New England Biolabs), the purified fragments were cloned into lentiviral vectors (pCDH-EF1-MCS-IRES GFP and pCDH-CMV-MCS-EF1-copGFP+puro, SBI) digested with the same restriction enzymes.

Car-E6-Fc/8/41Bb/Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 313 and 314). The gBLOCKs and the purified vector were ligated using the Gibson assembly cloning kit (New England Biolabs).

Car-E6-Fch/8/41Bb/Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 317 and 314). The gBLOCKs and the purified vector were ligated using the Gibson assembly cloning kit (New England Biolabs).

Car-E6-Fc-4-41Bb-Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 313 and 320). The gBLOCKs and the purified vector were ligated using the Gibson assembly cloning kit (New England Biolabs).

Car-E6 FcH/4/41Bb/Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 317 and 320). The gBLOCKs and the purified vector were ligated using the Gibson assembly cloning kit (New England Biolabs).

Car-E6 IgD/8/41Bb/Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 325 and 326). The gBLOCKs and the purified vector were ligated using the Gibson assembly cloning kit (New England Biolabs).

Car-E6 IgD/4/41Bb/Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 329 and 326). The gBLOCKs and the purified vector were ligated using the Gibson assembly cloning kit (New England Biolabs).

Car-E6 X4/8/41Bb/Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 332 and 326). The gBLOCKs and the purified vector were ligated using the Gibson assembly cloning kit (New England Biolabs).

Car-E6 X4/4/41Bb/Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 335 and 326). The gBLOCKs and the purified vector were ligated using the Gibson assembly cloning kit (New England Biolabs).

Car E6-8+4-4-41Bb-Cd3z Cloning:

pCDH-CMV-MCS-EF1-copGFP+puro (SBI) was digested with NheI and NotI (New England Biolabs) and the vector was purified. gBLOCKs were synthesized by our request by IDT, IA (SEq ID NOS: 312, 338 and 326). The gBLOCKs and the purified vector were ligated using the Gibson assembly cloning kit (New England Biolabs).

Example 5-Lentivirus Production

HEK 293T cells (ATCC) were used to produce lentivirus. The day prior transfection plates (6well plate) were coated with poly-D-lysine and cells seeded so that cell density reaches 90-95% at the time of transfection and cultures in a 5% CO2 atmosphere. The next daycells were transfected with Lipofectamine 3000 (life technologies) and Opti-MEM® I Reduced Serum Medium according to the manufacturer instructions(0.75 ug of lentiviral expression vecotr and 2.25 ug of pPACKH1 packaging mix was used). After 6h incubation, the media was changed and media containing lentivirus was harvested after 24 and 48 hours. Lentivirus was concentrated with Lenti-X concentrator (Clontech) and titer was calculated using the Lenti-X p@4 Rapid Titer Kit (Clontech). Lentivirus was store at −80C in single-use aliquots.

Example 6-Lipofectamine Transient Expression

HEK 293T cells (ATCC) were used to test expression of humanized IgG. The night before transfection, cells were passed at 1/3 dilution (6well plate) and cultures in a 5% CO2 atmosphere. The next day, 1 hour before transfection, the media was change to complete media without antibiotics (DMEM high glucose from ATCC containing 10% fetal calf serum). For transfection, we used Lipofectamine 3000 (life technologies) and Opti-MEM® I Reduced Serum Medium according to the manufacturer instructions. 1.25 ug of the heavy chain construct and 1.25 ug of the light chain construct or 2,5 ug of Fc-fusion constructs was used. After 48h incubation, the media was collected, cleared by centrifugation and used in an ELISA assay to quantify the level of humanized IgG expression and binding to PSMGFR peptide.

Example 7-Polyethylenimine (PEI) Large Scale Transient Expression

HEK 293T cells (ATCC) were used for large scale expression of Fc-fusion protein. The night before transfection, cells were passed ($6.5 \times 10^6$ cells in 150 mm dish) and cultures in a 5% CO2 atmosphere. The next day, 1 hour before transfection, cell were washed once with PBS pH 7.4 and the media was change to complete media without antibiotics (DMEM high glucose from ATCC containing 10% ultra low IgG fetal calf serum). For transfection, we used Polyethylenimine "Max" (PEI "Max", Polysciences) and Opti-MEM® I Reduced Serum Medium (25 ug of Fc-fusion constructs+250 ug of PEI). After 72h incubation, the media was collected and stored at −20° C. or cleared by centrifugation/filtration for purification.

Example 8-Jurkat Cells Lentivirus Transduction

Protocol #1: A 50/50 solution (2 mL) of lentivirus was prepared in fresh media, supplemented with 8 ug/mL of polybrene and added to a well of a 6 well plate. Jurkat E6-1 cells (ATCC, TIB-152) were pelleted at 1200 rpm for 5 min at RT and resuspended in fresh media (RPMI containing 10% fetal calf serum and 1% penicillin/streptomycin/amphotericin b). Cells were counted and add $2 \times 10^5$ cells to the well containing the virus+Polybrene solution. Incubate for 24-48h and add fresh media and/or split the cells. After 72h, start growing cells with antibiotic selection (puromycin).

Protocol #2: Jurkat E6-1 cells (ATCC, TIB-152) were pelleted at 1200 rpm for 5 min at RT and resuspended in fresh media (RPMI containing 10% fetal calf serum and 1% penicillin/streptomycin/amphotericin b) at $2.5 \times 10^5$ cells/mL. Add 2 mL of cells to a 15 mL sterile conical tube, add 1X of Transdux infection reagent (1X, SBI) and lentivirus. Mix gently and incubate at RT for 20 min. Centrifuge cells at 1900 rpm for 30 min at 32° C., remove supernatant, resuspend cells in 2 mL of fresh media and transfer cells to a well of a 6 well plate. Inspect cells for GFP expression after 48h.

Example 9-T Cells Lentivirus Transduction

Highly purified T cells (AllCells) were pelleted at 200 xg for 5 min at RT and resuspended at $1 \times 10^6$ cells/mL in fresh media (RPMI1640 containing 10% fetal calf serum and 1% penicillin/streptomycin). Add CD3/CD28 activator Dynabeads (Thermo Fisher, 25 uL for 1×10$^6$ cells) and seed 24 well plate with 1 mL of cells and add IL2 (Thermo Fisher). Monitor cells daily and split cells if needed. The day before the transduction coat a plate with Retronectin (Takara) and store it overnight at 4° C. The next, remove the Retronectin solution add add a blocking solution (2% BSA in PBS) and incubate 30 min at RT. Remove BSA solution add add PBS until cells are ready. Collect activated T cells and resuspend them at 0.5×10$^6$ cells/mL in fresh media. Add 1 mL of cells to the retronectin treated plate, 1 mL of lentivirus solution and IL2. Cells were spinoculated by centrifugation of the pate at 1000 xg for 90 min at RT. The plate was return to the incubator overnight. Next, remove 1 mL of media, add 1 mL of virus and repeat spinoculation. Monitor cells and split them if necessarry at a density of 0.5-1×10$^6$ cells/mL. T cells can be used for cytokine release assay or cytotoxicity assay 48h post transduction.

Example 10-IL2 Detection

IL-2 secretion in media was measured using a human IL-2 ELISA kit (Thermo Fisher). Plates were coated with and anti-IL-2 antibody (coating antibody, 1/100 in PBS). After overnight incubation at 4° C., the plate was wash 3 times with PBS-T and a 4% BSA solution was added to block remaining binding site on the well. After 1h at RT the plate was washed once with PBS-T and conditioned media (CM) and IL-2 standard diluted in PBS+4% BSA, was added. After 2h at RT the plate was washed 3× with PBS-T and anti-human IL-2 (detection antibody) diluted in PBS+4% BSA (1/100), was added. After 2h at RT the plate was washed 5× with PBS-T and Streptavidin-HRP (1/400) was added. After 30 min at RT, the plate was washed 7× with PBS-T (soak 1 min each wash) and.substrate solution was added. The reaction was stopped after 20 min by adding the stop solution and absorbance was read at 450 nm (minus absorbance at 550 nm) within 30 min of stopping.

Example 11-IFN-γ Detection

IFN-γ secretion in media was measured using a human IFN-γ ELISA kit (Biolegend). Plates were coated with and anti-IFN-γ antibody (capture antibody, 1X in coating buffer). After overnight incubation at 4° C., the plate was washed 4 times with PBS-T and blocking solution was added to block remaining binding site on the well. After 1h at RT (shaking at 500 rpm) the plate was washed 4 times with PBS-T and conditioned media (CM) and IFN-γ standard, was added. After 2h at RT with shaking, the plate was washed 4 times with PBS-T and detection antibody (1X), was added. After 1h at RT with shaking, the plate was washed 4 times with PBS-T and Avidin-HRP (1X) was added. After 30 min at RT with shaking, the plate was washed 5 times with PBS-T (soak 1 min each wash) and TMB substrate solution was added. The reaction was stopped after 20 min by adding the stop solution and absorbance was read at 450 nm (minus absorbance at 570 nm) within 15 min of stopping.

Example 12— CAR T Cytotoxicity Assay

Human T cells were isolated from whole blood according to standard protocols. The T cells were then separately transduced twice with lenti virus bearing the CAR constructs, wherein the CAR constructs bear a GFP tag. Following 2-3 days of culture in RPMI 10% FBS and IL-2, the cells were stained with F(ab')2 to label surface expression of MN-E6, MN-C2, MN-C3 and MN-C8. Cells were then sorted by flow cytometry for Fab-positive, GFP-positive cells. That means that the double positive population had a CAR inserted and that the CAR exposed the correct antibody fragment. The CAR T cells were then ready to be mixed with the MUC1* negative control cells or the target MUC1* positive cancer cells.

The target cells were prepared as follows: Harvest target cells and resuspend cells in serum-free medium containing 15 uM of CMTMr dye (Cell Tracker Orange, 5-and-6-4-chloromethyl benzoyl amino tetramethylrhodamine, Thermo Fisher) at 1-1.5×10$^6$ cells/mL. Incubate 30 min under growth conditions appropriate to particular cell type. Wash in culture media and transfer stained cells to a new tube and incubate the cells 60 min in media. Wash 2 more times in culture media to get rid of all excess dye. Set up the assay in 24 well plates with 0.5 ml media total volume. Resuspend the target cells (and control target cells) so that there are always 20,000 cells per well (20,000 cells/250 ul). Plate 250 ul in each well. Add 250 ul of the T cells so that the ratio of T cell: target cells=20:1, 10:1, 5:1 or 1:1. . . Analyse cells after 24 h and 72h. For suspension target cells, take off the 0.5 ml media from the well and place in tube, wash the well with 0.5 ml media or PBS. For adherent target cells, take off the 0.5 ml media from the well and place in tube, wash the well with 0.5 ml PBS. Add the PBS to the same tube and add 120 ul trypsin to the well. Incubate for 4 min then add 0.5 ml media to neutralize trypsin and place that in the tube as well. Spin cells and resuspend pellet in 100 ul FACS buffer. Spin cells again. Resuspend cells in 100 ul buffer+5 ul anti-CD3 antibody, for 30 min on ice (to stain T cells). After 30 min, wash stained cells 2× with FACS buffer and resuspend in 250 ul buffer. Run the cells through the filter cap of the FACS tube. 10 min prior to analysis, add 10 ul 7AAD dye to each tube and analyze with Fortessa under the Cytotoxicity template.

Example 13-ELISA Expression Level of Humanized IgG

Figure 9:
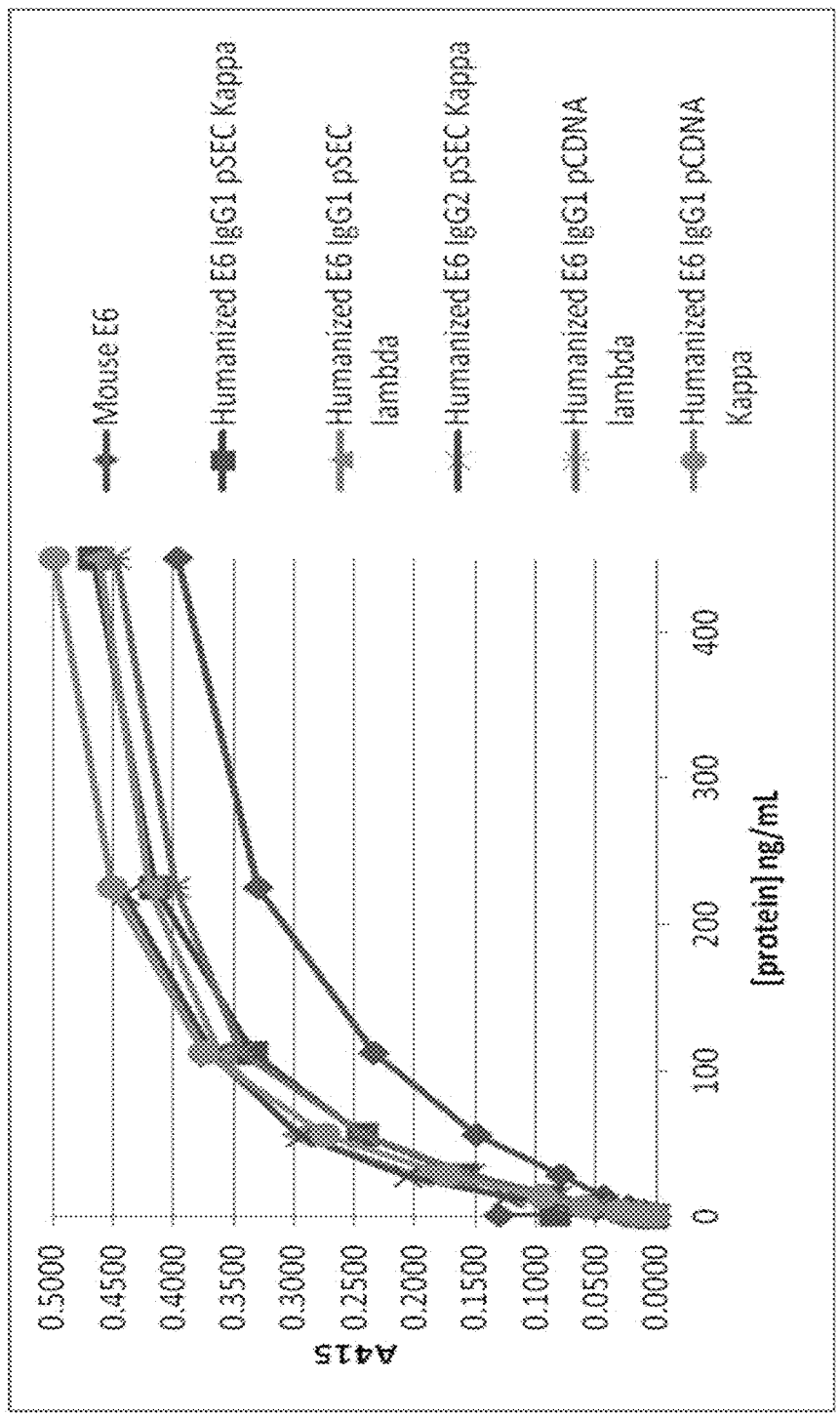
FIG. 9 is a graph of an ELISA assay comparing the binding of the parent mouseMN-E6 antibody to the humanized versions of theMN-E6 antibody to a surface presenting the PSMGFR peptide derived from the MUC1* extracellular domain.
Figure 11:
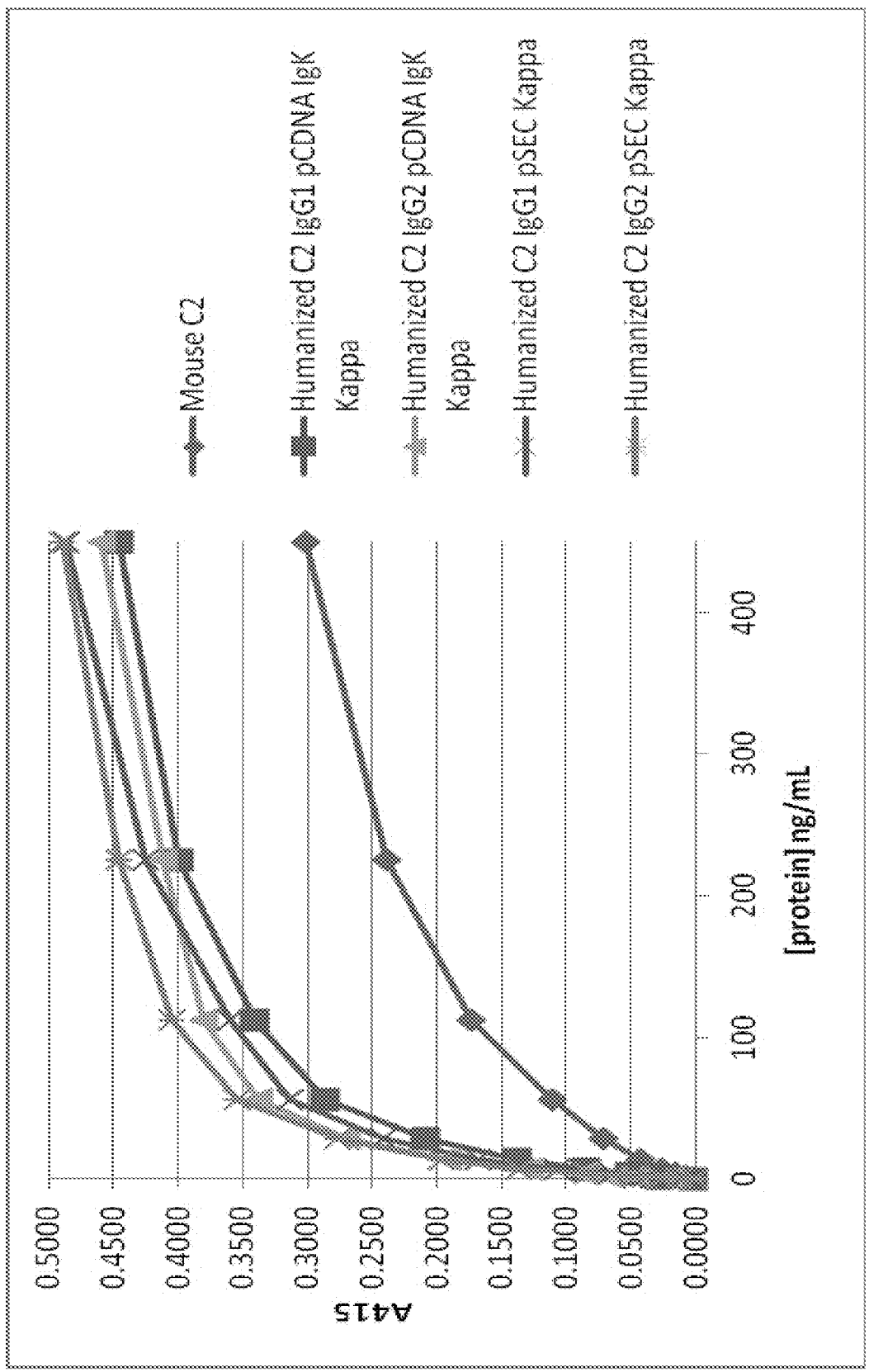
FIG. 11 is a graph of an ELISA assay comparing the binding of the parent mouse MN-C2 antibody to the humanized versions of the MN-C2 antibody to a surface presenting the PSMGFR peptide derived from the MUC1* extracellular domain.
Figure 12:
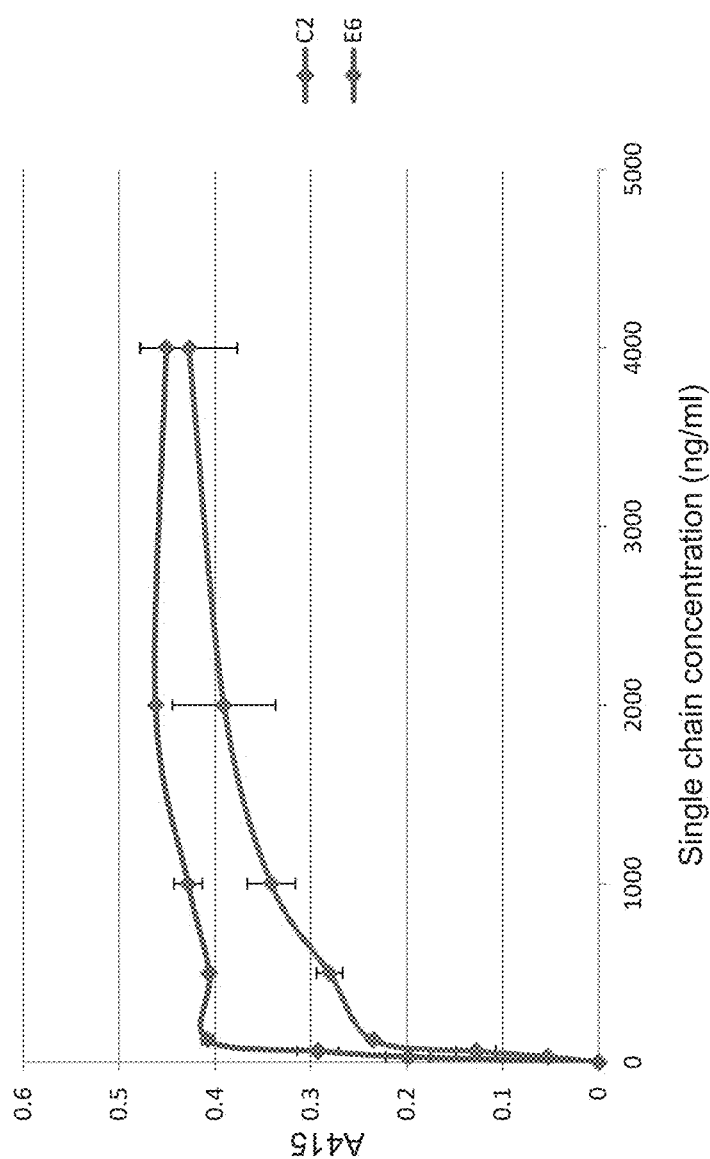
FIG. 12 is a graph of an ELISA assay showing binding of humanized single chain (scFv) MN-C2 andMN-E6 antibodies binding to a surface presenting the PSMGFR peptide derived from the MUC1* extracellular domain.

Goat Anti-human Fc specific antibody was diluted to 5 ug/mL in 0.1M carbonate/bicarbonate buffer pH 9.6 and 50 uL was added to each well of a 96 well plate. After overnight incubation at 4° C., the plate was wash twice with PBS-T and a 3% BSA solution was added to block remaining binding site on the well. After 1h at RT the plate was washed twice with PBS-T and conditioned media (CM), diluted in PBS-T+1% BSA, was added at different concentrations. Also, purified human IgG (life technologies), diluted in PBS-T+1% BSA, was added at different concentrations to make a standard curve for determination of the expression level of the humanized IgG or Fc-fusion protein. After 1h at RT the plate was washed 3× with PBS-T and anti-human (H+L) HRP (life technologies) diluted in PBS-T+1% BSA, was added at 1/2500. After 1h at RT the plate was washed 3× with PBS-T and binding of human IgG and humanized IgG was measured at 415 nm using a ABTS solution (ThermoFisher) (FIG. 9 (MN-E6) and FIG. 11 (MN-C2)).

Figure 8:
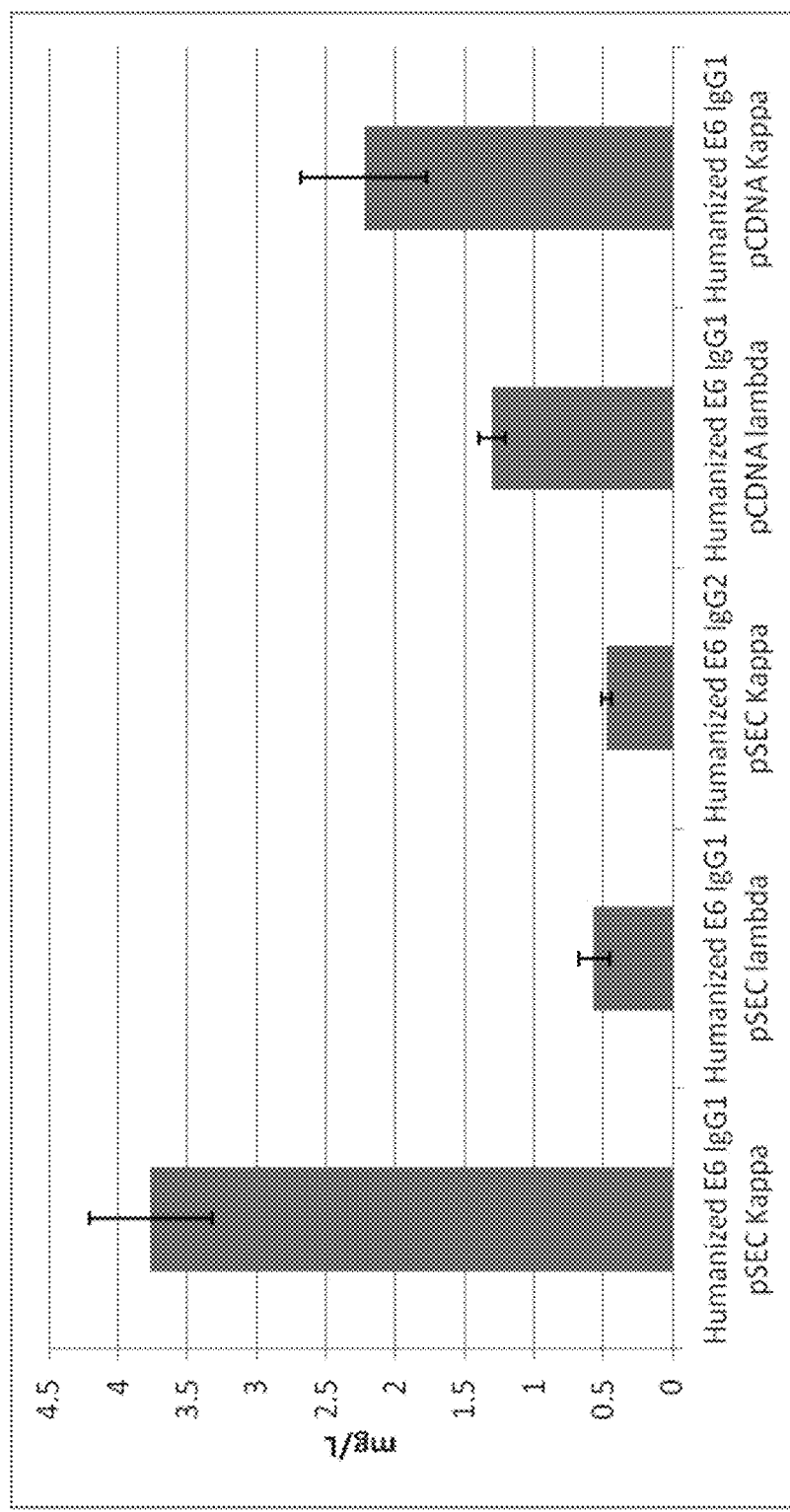
FIG. 8 is a graph of an ELISA assay showing differing levels of expression of humanizedMN-E6 anti-MUC1* antibody depending on whether the light chain was kappa or lambda and whether the variable portion was fused to a human IgG1 or IgG2.

Example 14-ELISA Humanized IgG Binding to PSMGFR Peptide of the MUC1* Extracellular Domain A synthetic peptide of sequence PSMGFR was covalently coupled to BSA using Imject Maleimide activated BSA kit (Thermo Fisher). PSMGFR coupled BSA was diluted to 7.5 ug/mL in 0.1M carbonate/bicarbonate buffer pH 9.6 and 50 uL was added to each well of a 96 well plate. After overnight incubation at 4° C., the plate was wash twice with PBS-T and a 3% BSA solution was added to block remaining binding site on the well. After 1h at RT the plate was washed twice with PBS-T and conditioned media (CM), diluted in PBS-T+1% BSA, was added at different concentrations. At the same time corresponding mouse IgG was diluted in PBS-T+1% BSA and added at different concentrations as binding control. After 1h at RT the plate was washed 3x with PBS-T and anti-human (H+L) HRP (life technologies) diluted in PBS-T+1% BSA, was added at 1/5000 to detect binding of humanized IgG. Anti-Mouse HRP (life technologies) diluted in PBS-T+1% BSA, was added at 1/2500 to detect binding of mouse IgG. After 1h at RT the plate was washed 3x with PBS-T and binding was measured at 415 nm using a ABTS solution (ThermoFisher) (FIG. 8 (MN-E6) and FIG. 10 (MN-C2)).

Example 15-Stable Cell Lines Generation

CHO-K1 cells (ATCC) were used to create stable cell lines expressing high level of humanized IgG. HEK293 cells (ATCC) were used to create stable cell lines expressing high level of Fc-fusion proteins. The night before transfection, cells were passed at 1/3 dilution (6well plate) and cultures in a 5% CO2 atmosphere. The next day, 1 hour before transfection, the media was change to complete media without antibiotics (F12K or DMEM containing 10% fetal calf serum). For transfection, we used Lipofectamine 3000 (life technologies) and Opti-MEM® I Reduced Serum Medium according to the manufacturer instructions. 1.25 ug of the heavy chain construct and 1.25 ug of the light chain construct or 2.5 ug of Fc-fusion constructs was used. After 24h, cells were trypsinized and plated into a T75 flask (in F12K or DMEM containing 10% fetal calf serum). After 24h, cells were trypsinized, diltuted to 100 cells/mL and 1000cells/mL in F 12K or DMEM containing 10% FCS and selection agent (Zeocin for pSECTag2 or G418 for pCDNA 3.1 V5), plated in 96 well plate (100 uL per well) and cultures in a 5% CO2 atmosphere. After 2-3 weeks, the culture media from single clones were collected, cleared by centrifugation and used in an ELISA assay to quantify the level of humanized IgG expression and binding to PSMGFR peptide. The clones with the highest expression and PSMGFR binding were expanded for large scale expression.

Example 16-scFV Expression pET21b E6 scFV plasmid (with HisTag or StrepTagII) was transformed into Shuffle T7 express competent cells (NEB). TB broth (Terrific broth) was inoculated with 1/100 of an overnight culture (LB broth-30° C.-200 rpm) and cultured at 30° C./200 rpm. When OD600 reached-1, temperature was reduced to 20° C. and growth was continued. After 2h, recombinant protein expression was induced with 0.2 mM Isopropyl-β-D-thio-galactoside (IPTG, Gold Biotechnology) and culture was stopped after 22h. After harvesting the cells by centrifugation (6000 rpm for 10 min at 4° C.), cell pellet was resupended with running buffer. For Histag protein buffer was: 50 mM Tris pH8.0, 300 mM NaCl and 5 mM imidazole. For StrepTagII protein buffer was 100 mM Tris pH 8.0 and 150 mM NaCl.

Example 17-HisTag EscFV Purification

MgCl2 (0.5 mM), DNAse (0.5 ug/mL, Sigma), PMSF (1 mM, Gold Bitotechnology) and BugBuster (1X, Novagen) was added. Cell suspension was incubated on a rotating platform for 20 min at RT. Insoluble cell debris was removed by centrifugation (20000 rpm for 30 min at 4° c.). The cleared lysate was then applied to a Ni-NTA column (Qiagen) equilibrated with the running buffer. The column was washed before eluting the protein off the column with the running buffer supplemented with 495 mM imidazole. The protein was further purified by size exclusion chromatography (Superdex 200). The fractions containing the protein were pooled, aliquoted and stored at −80° C.

Example 18-Streptagii Escfv Purification

MgCl2 (0.5 mM), DNAse (0.5 ug/mL, Sigma), PMSF (1 mM, Gold Bitotechnology) and BugBuster (1X, Novagen) was added. Cell suspension was incubated on a rotating platform for 20 min at RT. Insoluble cell debris was removed by centrifugation (20000 rpm for 30 min at 4° c.). The cleared lysate was then applied to a Strep-Tactin column (IBA) equilibrated with the running buffer. The column was washed before eluting the protein off the column with the running buffer supplemented with 5 mM d-Desthiobiotin. The protein was further purified by size exclusion chromatography (Superdex 200). The fractions containing the protein were pooled, aliquoted and stored at −80° C.

Example 19-Humanize IgG/Fc-Fusion Purification

Condition media (from transient transfection or stable cell line) was collected, cleared by centrifugation and filtered (0.2 um). The media was then loaded on a protein A (Genscript) or CaptureSelect FcXL (Thermo Fisher) and the protein purified according to manufacturer instructions using acid condition for elution. The eluted protein was then dialyzed against PBS pH 7.4 and further purified by size exclusion chromatography (Superdex 200). The fractions containing the protein were pooled, aliquoted and stored at −80° C.

Example 20-Immunohistochemistry

Human tissue specimens were purchased from Biomax. The tissues were either normal or cancerous as determined by a board certified pathologist. Tissues were anonymized but were labeled with a number, tissue type, stage of cancer and if available, a TNM tumor grading designation. TNM grading is as follows: T is primary tumor. Tx is primary tumor cannot be assessed. T0 is no evidence of a tumor. This is carcinoma in situ, intraepithelial or invasion of lamina propia. T1 is tumor invades submucosa. T2 is tumor invades muscularis propia. T3 is tumor invades through muscularis propia into subserosa or into non-peritonealized pericolic or perirectal tissues. T4 is tumor directly invades other organs or structures and/or perforate visceral peritoneum. N is regional lymph nodes. N0 is no regional lymph node metastasis. N1 is metastasis in 1 to 3 regional lymph nodes. N2 is metastatic in 4 or more regional lymph nodes. M is for distant metastasis. M0 means no distant metastasis. M1 is distant metastasis.

Tissues were stained with a primary anti-MUC1* antibody mouse monoclonal MN-C2, MN-E6, humanized MN-E6 scFv-Fc, or humanized MN-E6 scFv-Fc-biotin. If the primary were a mouse monoclonal antibody, then the secondary antibody used was a rabbit anti-mouse HRP-conjugated antibody. If the primary were a humanized antibody, then the secondary was a goat-anti-human HRP conjugated antibody antibody. If the primary were a biotinylated antibody, then the secondary was a streptavidin HRP conjugated antibody.

Tissue specimens were de-paraffinized using xylene and ethanol according to standard protocols. An antigen retrieval procedure was used for some tissues which involved 10 mM Sodium Citrate-0.05% Tween pH 6 buffer (pre boil buffer, keep warm) boil 10', cool down 20' in rice cooker, then rinse cold tap water 5 minutes then two 5 min. washes in TBS. Tissues were blocked for 1 hr at RT in 10% NGS plus 5% BSA in TBS. If the primary antibody used was humanized MN-E6scFv, which was conjugated to biotin so that it could be visualized by a secondary antibody, the tissues were pre-blocked with an avidin solution then a biotin solution. Primary antibodies were incubated with tissues overnight at 4 degrees C. in 1% BSA-TBS with gentle orbital rotation. Tissues were rinsed with TBS-T for 5 minutes with gentle rocking. For HRP-conjugate detection only, mounted tissues were incubated in 3% $H_2O_2$ in TBS for 15 minutes at RT. For tissues incubated with biotinylated primary antibodies, they were then bathed in StreptAvidin for 10 min with Streptavidin-HRP label (Biocare Cat #: HP604 G, H, L), then washed 3 times for 5 minutes at RT in TBS-T with gentle rocking. They were then developed with chromogen (DAB—1 mL diluent; 1 drop DAB substrate) for 5 minutes at RT, then rinsed with running tap water for 5 minutes. They were then counterstained for 1 second hematoxylin then brief dip in 0.08% NH4OH 'bluing reagent' followed by 5 minutes in running water. Tissues were then dehydrated and mounted with Cytoseal XYL (1 drop/section) and cover-slipped.

All of the references cited herein are incorporated by reference in their entirety.

Those skilled in the art will recognize, or be able to ascertain using no more than routine experimentation, many equivalents to the specific embodiments of the invention specifically described herein.

SEQUENCE LISTING (643 sequences)

SEQ ID NO: 1 - protein, 1255 aa, Artificial Sequence
  MUC1 Receptor
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 2 - protein, 45 aa, Artificial Sequence
  PSMGFR
GTINVHDVETQFNQYKTEAASRYNLTISDVSVSDVPFPFSAQSGA

SEQ ID NO: 3 - DNA, 459 bp, Artificial Sequence
  Human NME1
atggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatga

SEQ ID NO: 4 - protein, 152 aa, Artificial Sequence
  Human NME1
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 5 - DNA, 1131 bp, Artificial Sequence
  Human NME7
atgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattag

SEQ ID NO: 6 - protein, 376 aa, Artificial Sequence
  Human NME7
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 7 - protein, 16 aa, Artificial Sequence
  NME7 peptide 1 (A domain)
MLSRKEALDFHVDHQS

SEQ ID NO: 8 - protein, 11 aa, Artificial Sequence
  NME7A peptide 2 (A domain)
SGVARTDASES

SEQ ID NO: 9 - protein, 20 aa, Artificial Sequence
  NME7B peptide 1 (B domain)
DAGFEISAMQMFNMDRVNVE

SEQ ID NO: 10 - protein, 16 aa, Artificial Sequence
  NME7B peptide 2 (B domain)
EVYKGVVTEYHDMVTE

SEQ ID NO: 11 - protein, 29 aa, Artificial Sequence
  NME7B peptide 3 (B domain)
AIFGKTKIQNAVHCTDLPEDGLLEVQYFF

SEQ ID NO: 12 - DNA, 366 bp, Artificial Sequence
  Mouse E6 Heavy chain variable region sequence
gaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctca

SEQ ID NO: 13 - protein, 122 aa, Artificial Sequence
  Mouse E6 Heavy chain variable region sequence
EVKVVESGGDLVKPGGSLKLSCVVSGFTFSRYGMSWVRQTPGKRLEWVATISGGGTYIYYPDSVKGRFTISRDNAKNTLYLQMSSLKSEDTAMYHCTRDNYGRNYDYGMDYWGQGTSVTVSS

SEQ ID NO: 14 - DNA, 75 bp, Artificial Sequence
  Mouse E6 heavy chain variable framework region 1 (FWR1) sequence
gaggtgaaggtggtggagtctgggggagacttagtgaagcctggagggtccctgaaactctcctgtgtagtctct

SEQ ID NO: 15 - protein, 30 aa, Artificial Sequence
  Mouse E6 heavy chain variable framework region 1 (FWR1) sequence
EVKVVESGGDLVKPGGSLKLSCVVSGFTFS

SEQ ID NO: 16 - DNA, 30 bp, Artificial Sequence
  Mouse E6 heavy chain variable complementarity determining regions 1 (CDR1) sequence
ggattcactttcagtagatatggcatgtct

SEQ ID NO: 17 - protein, 5 aa, Artificial Sequence
  Mouse E6 heavy chain variable complementarity determining regions 1 (CDR1) sequence
RYGMS

SEQ ID NO: 18 - DNA, 42 bp, Artificial Sequence
  Mouse E6 heavy chain variable framework region 2 (FWR2) sequence
tgggttcgccagactccaggcaagaggctggagtgggtcgca

SEQ ID NO: 19 - protein, 14 aa, Artificial Sequence
  Mouse E6 heavy chain variable framework region 2 (FWR2) sequence
WVRQTPGKRLEWVA

SEQ ID NO: 20 - DNA, 51 bp, Artificial Sequence
  Mouse E6 heavy chain variable complementarity determining regions 2 (CDR2) sequence
accattagtggtggcggtacttacatctactatccagacagtgtgaagggg

SEQ ID NO: 21 - protein, 17 aa, Artificial Sequence
  Mouse E6 heavy chain variable complementarity determining regions 2 (CDR2) sequence
TISGGGTYIYYPDSVKG

SEQ ID NO: 22 - DNA, 96 bp, Artificial Sequence
  Mouse E6 heavy chain variable framework region 3 (FWR3) acid sequence
cgattcaccatctccagagacaatgccaagaacaccctgtacctgcaaatgagcagtctgaagtctgaggacacagccatgtatcactgtacaagg

SEQ ID NO: 23 - protein, 32 aa, Artificial Sequence
  Mouse E6 heavy chain variable framework region 3 (FWR3) acid sequence
RFTISRDNAKNTLYLQMSSLKSEDTAMYHCTR

SEQ ID NO: 24 - DNA, 39 bp, Artificial Sequence
  Mouse E6 heavy chain variable complementarity determining regions 3 (CDR3) sequence
gataactacggtaggaactacgactacggtatggactac

SEQ ID NO: 25 - protein, 13 aa, Artificial Sequence
  Mouse E6 heavy chain variable complementarity determining regions 3 (CDR3) sequence
DNYGRNYDYGMDY

SEQ ID NO: 26 - DNA, 294 bp, Artificial Sequence
  IGHV3-21*03 heavy chain variable region sequence
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgaga

SEQ ID NO: 27 - protein, 98 aa, Artificial Sequence
  IGHV3-21*03 heavy chain variable region sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAR

SEQ ID NO: 28 - DNA, 90 bp, Artificial Sequence
  IGHV3-21*01 heavy chain variable framework region 1 (FWR1) sequence
gaggtgcagctggtggagtctgggggaggcctggtcaagcctggggggtccctgagactctcctgtgcagcctctggattcaccttcagt

SEQ ID NO: 29 - protein, 30 aa, Artificial Sequence
  IGHV3-21*01 heavy chain variable framework region 1 (FWR1) sequence
EVQLVESGGGLVKPGGSLRLSCAASGFTFS

SEQ ID NO: 30 - DNA, 15 bp, Artificial Sequence
  IGHV3-21*01 heavy chain variable complementarity determining regions 1 (CDR1) sequence
agctatagcatgaac

SEQ ID NO: 31 - protein, 5 aa, Artificial Sequence
  IGHV3-21*01 heavy chain variable complementarity determining regions 1 (CDR1) sequence
SYSMN

SEQ ID NO: 32 - DNA, 42 bp, Artificial Sequence
  IGHV3-21*01 heavy chain variable framework region 2 (FWR2) sequence
tgggtccgccaggctccagggaaggggctggagtgggtctca

SEQ ID NO: 33 - protein, 14 aa, Artificial Sequence
  IGHV3-21*01 heavy chain variable framework region 2 (FWR2) sequence
WVRQAPGKGLEWVS

SEQ ID NO: 34 - DNA, 51 bp, Artificial Sequence
  IGHV3-21*01 heavy chain variable complementarity determining regions 2 (CDR2) sequence
tccattagtagtagtagtagttacatatactacgcagactcagtgaagggc

SEQ ID NO: 35 - protein, 17 aa, Artificial Sequence
  IGHV3-21*01 heavy chain variable complementarity determining regions 2 (CDR2) sequence
SISSSSSYIYYADSVKG

SEQ ID NO: 36 - DNA, 96 bp, Artificial Sequence
  IGHV3-21*01 heavy chain variable framework region 3 (FWR3) sequence
cgattcaccatctccagagacaacgccaagaactcactgtatctgcaaatgaacagcctgagagccgaggacacggctgtgtattactgtgcgaga

SEQ ID NO: 37 - protein, 32 aa, Artificial Sequence
  IGHV3-21*01 heavy chain variable framework region 3 (FWR3) sequence
RFTISRDNAKNSLYLQMNSLRAEDTAVYYCAR

SEQ ID NO: 38 - DNA, 366 bp, Artificial Sequence
  Humanized E6 heavy chain variable region sequence
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagc

SEQ ID NO: 39 - protein, 122 aa, Artificial Sequence
  Humanized E6 heavy chain variable region sequence
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSS

SEQ ID NO: 40 - DNA, 90 bp, Artificial Sequence; identical to SEQ ID NO: 28
  Humanized E6 heavy chain variable framework region 1 (FWR1) acid sequence

SEQ ID NO: 41 - protein, 30 aa, Artificial Sequence; identical to SEQ ID NO: 29
  Humanized E6 heavy chain variable framework region 1 (FWR1) acid sequence

SEQ ID NO: 42 - DNA, 15 bp, Artificial Sequence
  Humanized E6 heavy chain variable complementarity determining regions 1 (CDR1) sequence
aggtatggcatgagc

SEQ ID NO: 43 - protein, 5 aa, Artificial Sequence
  Humanized E6 heavy chain variable complementarity determining regions 1 (CDR1) sequence
RYGMS

SEQ ID NO: 44 - DNA, 42 bp, Artificial Sequence
  Humanized E6 heavy chain variable framework region 2 (FWR2) acid sequence
tgggtccgccaggctccagggaagaggctggagtgggtctca

SEQ ID NO: 45 - protein, 14 aa, Artificial Sequence
  Humanized E6 heavy chain variable framework region 2 (FWR2) acid sequence
WVRQAPGKRLEWVS

SEQ ID NO: 46 - DNA, 51 bp, Artificial Sequence
  Humanized E6 heavy chain variable complementarity determining regions 2 (CDR2) sequence
accattagtggcggaggcacctacatatactacccagactcagtgaagggc

SEQ ID NO: 47 - protein, 17 aa, Artificial Sequence
  Humanized E6 heavy chain variable complementarity determining regions 2 (CDR2) sequence
TISGGGTYIYYPDSVKG

SEQ ID NO: 48 - DNA, 96 bp, Artificial Sequence
  Humanized E6 heavy chain variable framework region 3 (FWR3) acid sequence
cgattcaccatctccagagacaacgccaagaacaccctgtatctgcaaatgaacagcctgagagccgaggacacggctgtgtattactgtaccaga

SEQ ID NO: 49 - protein, 32 aa, Artificial Sequence
  Humanized E6 heavy chain variable framework region 3 (FWR3) acid sequence
RFTISRDNAKNTLYLQMNSLRAEDTAVYYCTR

SEQ ID NO: 50 - DNA, 39 bp, Artificial Sequence
  Humanized E6 heavy chain variable complementarity determining regions 3 (CDR3) sequence
gataactatggccgcaactatgattatggcatggattat

SEQ ID NO: 51 - protein, 13 aa, Artificial Sequence
  Humanized E6 heavy chain variable complementarity determining regions 3 (CDR3) sequence
DNYGRNYDYGMDY

SEQ ID NO: 52 - DNA, 1442 bp, Artificial Sequence
  Humanized E6 IgG2 heavy chain synthesized by Genescript
gaattctaagcttgggccaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaagtttaaactctaga

SEQ ID NO: 53 - protein, 477 aa, Artificial Sequence
  Humanized E6 IgG2 heavy chain synthesized by Genescript
  misc_feature (477)..(477): Xaa can be any naturally occurring amino acid
EFAWATMELGLRWVFLVAILEGVQCEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGKVTLX

SEQ ID NO: 54 - DNA, 981 bp, Artificial Sequence
  Human IgG2 heavy chain constant region sequence
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatag

SEQ ID NO: 55 - protein, 326 aa, Artificial Sequence
  Human IgG2 heavy chain constant region sequence
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 56 - DNA, 1362 bp, Artificial Sequence
  Humanized E6 IgG1 heavy chain sequence
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacccactgtatctgcaaatgaacagcctgagagccgaggacacggctgtgtattactgtcccagagataactatggccgcaactatgattatggcatggattattggggccagggcaccctggtgaccgtgagcagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 57 - protein, 452 aa, Artificial Sequence
  Humanized E6 IgG1 heavy chain sequence
EVQLVESGGGLVKPGGSLRLSCAASGFTFSRYGMSWVRQAPGKRLEWVSTISGGGTYIYYPDSVKGRFTISRDNAKNPLYLQMNSLRAEDTAVYYCPRDNYGRNYDYGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - DNA, 996 bp, Artificial Sequence
  Human IgG1 heavy chain constant region sequence
gctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 59 - protein, 330 aa, Artificial Sequence
  Human IgG1 heavy chain constant region sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - DNA, 560 bp, Artificial Sequence
  Human IgG1 heavy chain constant region gBLOCK#1 sequence
atggcatggattattggggccagggcaccctggtgaccgtgagcagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaag

SEQ ID NO: 61 - DNA, 557 bp, Artificial Sequence
  Human IgG1 heavy chain constant region gBLOCK#2 sequence
tacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataagtttaaacccgctgatcagcctcgactgtgccttctagttg

SEQ ID NO: 62 - DNA, 31 bp, Artificial Sequence
  E6 heavy chain variable region overlapping sequence
atggcatggattattggggccagggcaccct

SEQ ID NO: 63 - DNA, 33 bp, Artificial Sequence
  IgG1 heavy chain constant region overlapping region sequence
tacgtggacggcgtggaggtgcataatgccaag

SEQ ID NO: 64 - DNA, 33 bp, Artificial Sequence
  pCDNA3.1 V5 and pSECTag2 overlapping sequence
ccgctgatcagcctcgactgtgccttctagttg

SEQ ID NO: 65 - DNA, 318 bp, Artificial Sequence
  Mouse E6 Light Chain variable region sequence
caaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaa

SEQ ID NO: 66 - protein, 106 aa, Artificial Sequence
  Mouse E6 Light Chain variable region sequence
QIVLTQSPAIMSASPGEEVTLTCSATSSVSYIHWFQQRPGTSPKLWIYSTSNLASGVPVRFSGSGYGTSYSLTISRMEAEDAATYYCQQRSSSPFTFGSGTKLEIK

SEQ ID NO: 67 - DNA, 69 bp, Artificial Sequence
  Mouse E6 light chain variable framework region 1 (FWR1) sequence
caaattgttctcacccagtctccagcaatcatgtctgcatctccaggggaggaggtcaccctaacctgc

SEQ ID NO: 68 - protein, 23 aa, Artificial Sequence
  Mouse E6 light chain variable framework region 1 (FWR1) sequence
QIVLTQSPAIMSASPGEEVTLTC

SEQ ID NO: 69 - DNA, 30 bp, Artificial Sequence
  Mouse E6 light chain variable complementarity determining regions 1 (CDR1) sequence
agtgccacctcaagtgtaagttacatacac

SEQ ID NO: 70 - protein, 10 aa, Artificial Sequence
  Mouse E6 light chain variable complementarity determining regions 1 (CDR1) sequence
SATSSVSYIH

SEQ ID NO: 71 - DNA, 45 bp, Artificial Sequence
  Mouse E6 light chain variable framework region 2 (FWR2) sequence
tggttccagcagaggccaggcacttctcccaaactctggatttat

SEQ ID NO: 72 - protein, 15 aa, Artificial Sequence
  Mouse E6 light chain variable framework region 2 (FWR2) sequence
WFQQRPGTSPKLWIY

SEQ ID NO: 73 - DNA, 21 bp, Artificial Sequence
  Mouse E6 light chain variable complementarity determining regions 2 (CDR2) sequence
agcacatccaacctggcttct

SEQ ID NO: 74 - protein, 7 aa, Artificial Sequence
  Mouse E6 light chain variable complementarity determining regions 2 (CDR2) sequence
STSNLAS

SEQ ID NO: 75 - DNA, 96 bp, Artificial Sequence
  Mouse E6 light chain variable framework region 3 (FWR3) sequence
ggagtccctgttcgcttcagtggcagtggatatgggacctcttactctctcacaatcagccgaatggaggctgaagatgctgccacttattactgc

SEQ ID NO: 76 - protein, 32 aa, Artificial Sequence
  Mouse E6 light chain variable framework region 3 (FWR3) sequence
GVPVRFSGSGYGTSYSLTISRMEAEDAATYYC

SEQ ID NO: 77 - DNA, 27 bp, Artificial Sequence
  Mouse E6 light chain variable complementarity determining regions 3 (CDR3) sequence
cagcaaaggagtagttccccattcacg

SEQ ID NO: 78 - protein, 9 aa, Artificial Sequence
  Mouse E6 light chain variable complementarity determining regions 3 (CDR3) sequence
QQRSSSPFT

SEQ ID NO: 79 - DNA, 287 bp, Artificial Sequence
  IGKV3-11*02 light chain variable region sequence
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggagagacttcactctcaccatcagcagcctagagcctgaagattttgcagtttattactgtcagcagcgtagcaactggcctcc

SEQ ID NO: 80 - protein, 96 aa, Artificial Sequence
  IGKV3-11*02 light chain variable region sequence
EIVLTQSPATLSLSPGERATLSCRASQSVSSYLAWYQQKPGQAPRLLIYDASNRATGIPARFSGSGSGRDFTLTISSLEPEDFAVYYCQQRSNWPP

SEQ ID NO: 81 - DNA, 69 bp, Artificial Sequence
  IGKV3-11*02 light chain variable framework region 1 (FWR1) acid sequence
gaaattgtgttgacacagtctccagccaccctgtctttgtctccaggggaaagagccaccctctcctgc

SEQ ID NO: 82 - protein, 23 aa, Artificial Sequence
  IGKV3-11*02 light chain variable framework region 1 (FWR1) acid sequence
EIVLTQSPATLSLSPGERATLSC

SEQ ID NO: 83 - DNA, 33 bp, Artificial Sequence
  IGKV3-11*02 light chain variable complementarity determining regions 1 (CDR1) sequence
agggccagtcagagtgttagcagctacttagcc

SEQ ID NO: 84 - protein, 11 aa, Artificial Sequence
  IGKV3-11*02 light chain variable complementarity determining regions 1 (CDR1) sequence
RASQSVSSYLA

SEQ ID NO: 85 - DNA, 45 bp, Artificial Sequence
  IGKV3-11*02 light chain variable framework region 2 (FWR2) sequence
tggtaccaacagaaacctggccaggctcccaggctcctcatctat

SEQ ID NO: 86 - protein, 15 aa, Artificial Sequence
  IGKV3-11*02 light chain variable framework region 2 (FWR2) sequence
WYQQKPGQAPRLLIY

SEQ ID NO: 87 - DNA, 21 bp, Artificial Sequence
  IGKV3-11*02 light chain variable complementarity determining regions 2 (CDR2) sequence
gatgcatccaacagggccact

SEQ ID NO: 88 - protein, 7 aa, Artificial Sequence
  IGKV3-11*02 light chain variable complementarity determining regions 2 (CDR2) sequence
DASNRAT

SEQ ID NO: 89 - DNA, 96 bp, Artificial Sequence
  IGKV3-11*02 light chain variable framework region 3 (FWR3) sequence
ggcatcccagccaggttcagtggcagtgggtctgggagagacttcactctcaccatcagcagcctagagcctgaagattttgcagtttattactgt

SEQ ID NO: 90 - protein, 32 aa, Artificial Sequence
  IGKV3-11*02 light chain variable framework region 3 (FWR3) sequence
GIPARFSGSGSGTDFTLTISSLEPEDFAVYYC

SEQ ID NO: 91 - DNA, 23 bp, Artificial Sequence
  IGKV3-11*02 light chain variable complementarity determining regions3 (CDR3) sequence
cagcagcgtagcaactggcctcc

SEQ ID NO: 92 - protein, 8 aa, Artificial Sequence
  IGKV3-11*02 light chain variable complementarity determining regions3 (CDR3) sequence
QQRSNWPP

SEQ ID NO: 93 - DNA, 318 bp, Artificial Sequence
  Humanized E6 light chain variable region sequence
gaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 94 - protein, 106 aa, Artificial Sequence
  Humanized E6 light chain variable region sequence
EIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 95 - DNA, 69 bp, Artificial Sequence
  Humanized E6 light chain variable framework region 1 (FWR1) acid sequence
gaaattgtgttgacacagtctccagccaccctgtctttgtctccaggggaaagagccaccctcacctgc

SEQ ID NO: 96 - protein, 23 aa, Artificial Sequence
  Humanized E6 light chain variable framework region 1 (FWR1) acid sequence
EIVLTQSPATLSLSPGERATLTC

SEQ ID NO: 97 - DNA, 30 bp, Artificial Sequence
  Humanized E6 light chain variable complementarity determining regions 1 (CDR1) sequence
agcgccaccagcagtgttagctacatccac

SEQ ID NO: 98 - protein, 10 aa, Artificial Sequence
  Humanized E6 light chain variable complementarity determining regions 1 (CDR1) sequence
SATSSVSYIH

SEQ ID NO: 99 - DNA, 45 bp, Artificial Sequence
  Humanized E6 heavy light variable framework region 2 (FWR2) acid sequence
tggtaccaacagaggcctggccagagccccaggctcctcatctat

SEQ ID NO: 100 - protein, 15 aa, Artificial Sequence
  Humanized E6 heavy light variable framework region 2 (FWR2) acid sequence
WYQQRPGQSPRLLIY

SEQ ID NO: 101 - DNA, 21 bp, Artificial Sequence
  Humanized E6 light chain variable complementarity determining regions 2 (CDR2) sequence
agcacctccaacctggccagc

SEQ ID NO: 102 - protein, 7 aa, Artificial Sequence
  Humanized E6 light chain variable complementarity determining regions 2 (CDR2) sequence
STSNLAS

SEQ ID NO: 103 - DNA, 96 bp, Artificial Sequence
  Humanized E6 light chain variable framework region 3 (FWR3) acid sequence
ggcatcccagccaggttcagtggcagtgggtctgggagcgactacactctcaccatcagcagcctagagcctgaagattttgcagtttattactgt

SEQ ID NO: 104 - protein, 32 aa, Artificial Sequence
  Humanized E6 light chain variable framework region 3 (FWR3) acid sequence
GIPARFSGSGSGSDYTLTISSLEPEDFAVYYC

SEQ ID NO: 105 - DNA, 27 bp, Artificial Sequence
  Humanized E6 light chain variable complementarity determining regions 3 (CDR3) sequence
cagcagcgtagcagctcccctttcacc

SEQ ID NO: 106 - protein, 9 aa, Artificial Sequence
  Humanized E6 light chain variable complementarity determining regions 3 (CDR3) sequence
QQRSSSPFT

SEQ ID NO: 107 - DNA, 740 bp, Artificial Sequence
  Humanized E6 Kappa light chain synthesized by Genescript
gaattctaagcttgggccaccatggaagccccagcgcagcttctcttcctcctgctactctggctcccagataccactggagaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaaggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaagtttaaactctaga

SEQ ID NO: 108 - protein, 243 aa, Artificial Sequence
  Humanized E6 Kappa light chain synthesized by Genescript
  misc_feature (243)..(243): Xaa can be any naturally occurring amino acid
EFAWATMEAPAQLLFLLLLWLPDTTGEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECVTLX

SEQ ID NO: 109 - DNA, 324 bp, Artificial Sequence
  Human Kappa light chain constant region sequence
aggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 110 - protein, 107 aa, Artificial Sequence [sequence omitted]

SEQ ID NO: 111 - DNA, 642 bp, Artificial Sequence
  Humanized E6 lambda light chain sequence
gaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 112 - protein, 212 aa, Artificial Sequence
  Humanized E6 lambda light chain sequence
EIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 113 - DNA, 324 bp, Artificial Sequence
  Humanized lambda light chain constant region sequence
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 114 - protein, 106 aa, Artificial Sequence
  Humanized lambda light chain constant region sequence
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 115 - DNA, 614 bp, Artificial Sequence
  Human lambda light chain constant region gBLOCK#3 sequence
agcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaagtttaaacccgctgatcagcctcgactgtgccttctagttg

SEQ ID NO: 116 - DNA, 31 bp, Artificial Sequence
  E6 light chain variable region overlapping sequence
agcgccaccagcagtgttagctacatccact

SEQ ID NO: 117 - DNA, 33 bp, Artificial Sequence; identical to SEQ ID NO: 64
  pCDNA3.1 V5 and pSECTag2 overlapping sequence

SEQ ID NO: 118 - DNA, 390 bp, Artificial Sequence
  Mouse C2 heavy chain variable region sequence
gaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctat

SEQ ID NO: 119 - protein, 130 aa, Artificial Sequence
  Mouse C2 heavy chain variable region sequence
EVQLEESGGGLVKPGGSLKLSCAASGFTFSGYAMSWVRQTPEKRLEWVATISSGGTYIYYPDSVKGRFTISRDNAKNTLYLQMSSLRSEDTAMYYCARLGGDNYYEYFDVWGAGTTVTVSSAKTTPPSVY

SEQ ID NO: 120 - DNA, 90 bp, Artificial Sequence
  Mouse C2 heavy chain variable framework region 1 (FWR1) sequence
gaggtccagctggaggagtcagggggaggcttagtgaagcctggagggtccctgaaactctcctgtgcagcctctggattcactttcagt

SEQ ID NO: 121 - protein, 30 aa, Artificial Sequence
  Mouse C2 heavy chain variable framework region 1 (FWR1) sequence
EVQLEESGGGLVKPGGSLKLSCAASGFTFS

SEQ ID NO: 122 - DNA, 15 bp, Artificial Sequence
  Mouse C2 heavy chain variable complementarity determining regions 1 (CDR1) sequence
ggctatgccatgtct

SEQ ID NO: 123 - protein, 5 aa, Artificial Sequence
  Mouse C2 heavy chain variable complementarity determining regions 1 (CDR1) sequence
GYAMS

SEQ ID NO: 124 - DNA, 42 bp, Artificial Sequence
  Mouse C2 heavy chain variable framework region 2 (FWR2) sequence
tgggttcgccagactccggagaagaggctggagtgggtcgca

SEQ ID NO: 125 - protein, 14 aa, Artificial Sequence
  Mouse C2 heavy chain variable framework region 2 (FWR2) sequence
WVRQTPEKRLEWVA

SEQ ID NO: 126 - DNA, 51 bp, Artificial Sequence
  Mouse C2 heavy chain variable complementarity determining regions 2 (CDR2) sequence
accattagtagtggtggtacttatatctactatccagacagtgtgaagggg

SEQ ID NO: 127 - protein, 17 aa, Artificial Sequence
  Mouse C2 heavy chain variable complementarity determining regions 2 (CDR2) sequence
TISSGGTYIYYPDSVKG

SEQ ID NO: 128 - DNA, 96 bp, Artificial Sequence
  Mouse C2 heavy chain variable framework region 3 (FWR3) sequence
cgattcaccatctccagagacaatgccaagaacaccctgtacctgcaaatgagcagtctgaggtctgaggacacggccatgtattactgtgcaaga

SEQ ID NO: 129 - protein, 32 aa, Artificial Sequence
  Mouse C2 heavy chain variable framework region 3 (FWR3) sequence
RFTISRDNAKNTLYLQMSSLRSEDTAMYYCAR

SEQ ID NO: 130 - DNA, 36 bp, Artificial Sequence
  Mouse C2 heavy chain variable complementarity determining regions 3 (CDR3) sequence
cttgggggggataattactacgaatacttcgatgtc

SEQ ID NO: 131 - protein, 12 aa, Artificial Sequence
  Mouse C2 heavy chain variable complementarity determining regions 3 (CDR3) sequence
LGGDNYYEYFDV

SEQ ID NO: 132 - DNA, 294 bp, Artificial Sequence
  IGHV3-21*04 heavy chain variable region sequence
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggccgtgtattactgtgcgaga

SEQ ID NO: 133 - protein, 98 aa, Artificial Sequence; identical to SEQ ID NO: 27
  IGHV3-21*04 heavy chain variable region sequence

SEQ ID NO: 134 - DNA, 90 bp, Artificial Sequence; identical to SEQ ID NO: 28
  IGHV3-21*04 heavy chain variable framework region 1 (FWR1) sequence

SEQ ID NO: 135 - protein, 30 aa, Artificial Sequence; identical to SEQ ID NO: 29
  IGHV3-21*04 heavy chain variable framework region 1 (FWR1) sequence

SEQ ID NO: 136 - DNA, 15 bp, Artificial Sequence
  IGHV3-21*04 heavy chain variable complementarity determining regions 1 (CDR1) sequence
agctatagcatgaac

SEQ ID NO: 137 - protein, 5 aa, Artificial Sequence
  IGHV3-21*04 heavy chain variable complementarity determining regions 1 (CDR1) sequence
SYSMN

SEQ ID NO: 138 - DNA, 41 bp, Artificial Sequence
  IGHV3-21*04 heavy chain variable framework region 2 (FWR2) sequence
gggtccgccaggctccagggaaggggctggagtgggtctca

SEQ ID NO: 139 - protein, 14 aa, Artificial Sequence
  IGHV3-21*04 heavy chain variable framework region 2 (FWR2) sequence
WVRQAPGKGLEWVS

SEQ ID NO: 140 - DNA, 51 bp, Artificial Sequence; identical to SEQ ID NO: 34
  IGHV3-21*04 heavy chain variable complementarity determining regions 2 (CDR2) sequence

SEQ ID NO: 141 - protein, 17 aa, Artificial Sequence
  IGHV3-21*04 heavy chain variable complementarity determining regions 2 (CDR2) sequence
SISSSSSYIYYADSVKG

SEQ ID NO: 142 - DNA, 96 bp, Artificial Sequence
  IGHV3-21*04 heavy chain variable framework region 3 (FWR3) sequence
cgattcaccatctccagagacaacgccaagaactcactgtatctgcaaatgaacagcctgagagccgaggacacggccgtgtattactgtgcgaga

SEQ ID NO: 143 - protein, 32 aa, Artificial Sequence; identical to SEQ ID NO: 37
  IGHV3-21*04 heavy chain variable framework region 3 (FWR3) sequence

SEQ ID NO: 144 - DNA, 363 bp, Artificial Sequence
  Humanized C2 heavy chain variable region sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctcc

SEQ ID NO: 145 - protein, 121 aa, Artificial Sequence
  Humanized C2 heavy chain variable region sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSS

SEQ ID NO: 146 - DNA, 90 bp, Artificial Sequence; identical to SEQ ID NO: 28
  Humanized C2 heavy chain variable framework region 1 (FWR1) sequence

SEQ ID NO: 147 - protein, 30 aa, Artificial Sequence; identical to SEQ ID NO: 29
  Humanized C2 heavy chain variable framework region 1 (FWR1) sequence

SEQ ID NO: 148 - DNA, 15 bp, Artificial Sequence
  Humanized C2 heavy chain variable complementarity determining regions 1 (CDR1) sequence
ggctatgccatgagc

SEQ ID NO: 149 - protein, 5 aa, Artificial Sequence
  Humanized C2 heavy chain variable complementarity determining regions 1 (CDR1) sequence
GYAMS

SEQ ID NO: 150 - DNA, 43 bp, Artificial Sequence
  Humanized C2 heavy chain variable framework region 2 (FWR2) sequence
tgggtccgccaggctccagggaaggggctggagtgggtctcaa

SEQ ID NO: 151 - protein, 14 aa, Artificial Sequence
  Humanized C2 heavy chain variable framework region 2 (FWR2) sequence
WVRQAPGKGLEWVS

SEQ ID NO: 152 - DNA, 51 bp, Artificial Sequence
  Humanized C2 heavy chain variable complementarity determining regions 2 (CDR2) sequence
accattagtagtggcggaacctacatatactaccccgactcagtgaagggc

SEQ ID NO: 153 - protein, 17 aa, Artificial Sequence
  Humanized C2 heavy chain variable complementarity determining regions 2 (CDR2) sequence
TISSGGTYIYYPDSVKG

SEQ ID NO: 154 - DNA, 96 bp, Artificial Sequence; identical to SEQ ID NO: 142
  Humanized C2 heavy chain variable framework region 3 (FWR3) sequence

SEQ ID NO: 155 - protein, 32 aa, Artificial Sequence; identical to SEQ ID NO: 37
  Humanized C2 heavy chain variable framework region 3 (FWR3) sequence

SEQ ID NO: 156 - DNA, 36 bp, Artificial Sequence; identical to SEQ ID NO: 130
  Humanized C2 heavy chain variable complementarity determining regions 3 (CDR3) sequence

SEQ ID NO: 157 - protein, 12 aa, Artificial Sequence
  Humanized C2 heavy chain variable complementarity determining regions 3 (CDR3) sequence
LGGDNYYEYFDV

SEQ ID NO: 158 - DNA, 1359 bp, Artificial Sequence
  Humanized C2 IgG1 heavy chain sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 159 - protein, 451 aa, Artificial Sequence
  Humanized C2 IgG1 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - DNA, 616 bp, Artificial Sequence
  Humanized C2 gBLOCK#4 sequence
actcactatagggagacccaagctggctagttaagcttgggccaccatggagacagacacactcctgctatgggtactgctgctctgggttccaggttccactggtgacgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagc

SEQ ID NO: 161 - DNA, 32 bp, Artificial Sequence
  pCDNA3.1 V5 overlapping sequence
actcactatagggagacccaagctggctagtt

SEQ ID NO: 162 - DNA, 34 bp, Artificial Sequence
  Human IgG1 constant region overlapping sequence
gacggtgtcgtggaactcaggcgccctgaccagc

SEQ ID NO: 163 - DNA, 1347 bp, Artificial Sequence
  Humanized C2 IgG2 heavy chain sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaa

SEQ ID NO: 164 - protein, 447 aa, Artificial Sequence
  Humanized C2 IgG2 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 165 - DNA, 549 bp, Artificial Sequence
  Humanized C2 gBLOCK#5 sequence
tgctctgggttccaggttccactggtgacgcggcccagccggccgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgcctccaccaagggcccatcggtcttccccctggcgccctgctccaggagcacctccgagagcacagccgccctgggctgcctggtcaaggactacttccccgaaccggtgacggtgtcgtggaactcaggcgctctgacca

SEQ ID NO: 166 - DNA, 31 bp, Artificial Sequence
  pSEC Tag2 overlapping sequence
tgctctgggttccaggttccactggtgacgc

SEQ ID NO: 167 - DNA, 32 bp, Artificial Sequence
  Human IgG2 constant region overlapping sequence
gacggtgtcgtggaactcaggcgctctgacca

SEQ ID NO: 168 - DNA, 360 bp, Artificial Sequence
  Mouse C2 light chain variable region sequence
gacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatcc

SEQ ID NO: 169 - protein, 120 aa, Artificial Sequence
  Mouse C2 light chain variable region sequence
DIVITQSTASLGVSLGQRATISCRASKSVSTSGYSYMHWYQQRPGQPPKLLIYLASNLESGVPARFSGSGSGTDFTLNIHPVEEEDAATYYCQHSRELPFTFGGGTKLEIKRADAAPTVS

SEQ ID NO: 170 - DNA, 69 bp, Artificial Sequence
  Mouse C2 light chain variable framework region 1 (FWR1) sequence
gacattgtgatcacacagtctacagcttccttaggtgtatctctggggcagagggccaccatctcatgc

SEQ ID NO: 171 - protein, 23 aa, Artificial Sequence
  Mouse C2 light chain variable framework region 1 (FWR1) sequence
DIVITQSTASLGVSLGQRATISC

SEQ ID NO: 172 - DNA, 45 bp, Artificial Sequence
  Mouse C2 light chain variable complementarity determining regions 1 (CDR1) sequence
agggccagcaaaagtgtcagtacatctggctatagttatatgcac

SEQ ID NO: 173 - protein, 15 aa, Artificial Sequence
  Mouse C2 light chain variable complementarity determining regions 1 (CDR1) sequence
RASKSVSTSGYSYMH

SEQ ID NO: 174 - DNA, 45 bp, Artificial Sequence
  Mouse C2 light chain variable framework region 2 (FWR2) sequence
tggtaccaacagagaccaggacagccacccaaactcctcatctat

SEQ ID NO: 175 - protein, 15 aa, Artificial Sequence
  Mouse C2 light chain variable framework region 2 (FWR2) sequence
WYQQRPGQPPKLLIY

SEQ ID NO: 176 - DNA, 20 bp, Artificial Sequence
  Mouse C2 light chain variable complementarity determining regions 2 (CDR2) sequence
cttgcatccaacctagaatc

SEQ ID NO: 177 - protein, 7 aa, Artificial Sequence
  Mouse C2 light chain variable complementarity determining regions 2 (CDR2) sequence
LASNLES

SEQ ID NO: 178 - DNA, 97 bp, Artificial Sequence
  Mouse C2 light chain variable framework region 3 (FWR3) sequence
tggggtccctgccaggttcagtggcagtgggtctgggacagacttcaccctcaacatccatcctgtggaggaggaggatgctgcaacctattactgt

SEQ ID NO: 179 - protein, 32 aa, Artificial Sequence
  Mouse C2 light chain variable framework region 3 (FWR3) sequence
GVPARFSGSGSGTDFTLNIHPVEEEDAATYYC

SEQ ID NO: 180 - DNA, 27 bp, Artificial Sequence
  Mouse C2 light chain variable complementarity determining regions 3 (CDR3) sequence
cagcacagtagggagcttccgttcacg

SEQ ID NO: 181 - protein, 9 aa, Artificial Sequence
  Mouse C2 light chain variable complementarity determining regions 3 (CDR3) sequence
QHSRELPFT

SEQ ID NO: 182 - DNA, 303 bp, Artificial Sequence
  IGKV7-3*01 light chain variable region sequence
gacattgtgctgacccagtctccagcctccttggccgtgtctccaggacagagggccaccatcacctgcagagccagtgagagtgtcagtttcttgggaataaacttaattcactggtatcagcagaaaccaggacaacctcctaaactcctgatttaccaagcatccaataaagacactggggtcccagccaggttcagcggcagtgggtctgggaccgatttcaccctcacaattaatcctgtggaagctaatgatactgcaaattattactgtctgcagagtaagaattttcctcccaca

SEQ ID NO: 183 - protein, 101 aa, Artificial Sequence
  IGKV7-3*01 light chain variable region sequence
DIVLTQSPASLAVSPGQRATITCRASESVSFLGINLIHWYQQKPGQPPKLLIYQASNKDTGVPARFSGSGSGTDFTLTINPVEANDTANYYCLQSKNFPPT

SEQ ID NO: 184 - DNA, 69 bp, Artificial Sequence
  IGKV7-3*01 light chain variable framework region 1 (FWR1) sequence
gacattgtgctgacccagtctccagcctccttggccgtgtctccaggacagagggccaccatcacctgc

SEQ ID NO: 185 - protein, 23 aa, Artificial Sequence
  IGKV7-3*01 light chain variable framework region 1 (FWR1) sequence
DIVLTQSPASLAVSPGQRATITC

SEQ ID NO: 186 - DNA, 45 bp, Artificial Sequence
  IGKV7-3*01 light chain variable complementarity determining regions 1 (CDR1) sequence
agagccagtgagagtgtcagtttcttgggaataaacttaattcac

SEQ ID NO: 187 - protein, 15 aa, Artificial Sequence
  IGKV7-3*01 light chain variable complementarity determining regions 1 (CDR1) sequence
RASESVSFLGINLIH

SEQ ID NO: 188 - DNA, 45 bp, Artificial Sequence
  IGKV7-3*01 light chain variable framework region 2 (FWR2) sequence
tggtatcagcagaaaccaggacaacctcctaaactcctgatttac

SEQ ID NO: 189 - protein, 15 aa, Artificial Sequence
  IGKV7-3*01 light chain variable framework region 2 (FWR2) sequence
WYQQKPGQPPKLLIY

SEQ ID NO: 190 - DNA, 21 bp, Artificial Sequence
  IGKV7-3*01 light chain variable complementarity determining regions 2 (CDR2) sequence
caagcatccaataaagacact

SEQ ID NO: 191 - protein, 7 aa, Artificial Sequence
  IGKV7-3*01 light chain variable complementarity determining regions 2 (CDR2) sequence
QASNKDT

SEQ ID NO: 192 - DNA, 96 bp, Artificial Sequence
  IGKV7-3*01 light chain variable framework region 3 (FWR3) sequence
ggggtcccagccaggttcagcggcagtgggtctgggaccgatttcaccctcacaattaatcctgtggaagctaatgatactgcaaattattactgt

SEQ ID NO: 193 - protein, 32 aa, Artificial Sequence
  IGKV7-3*01 light chain variable framework region 3 (FWR3) sequence
GVPARFSGSGSGTDFTLTINPVEANDTANYYC

SEQ ID NO: 194 - DNA, 339 bp, Artificial Sequence
  Humanized C2 light chain variable region sequence
gacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaact

SEQ ID NO: 195 - protein, 113 aa, Artificial Sequence
  Humanized C2 light chain variable region sequence
DIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRT

SEQ ID NO: 196 - DNA, 69 bp, Artificial Sequence; identical to SEQ ID NO: 184
  Humanized C2 light chain variable framework region 1 (FWR1) acid sequence

SEQ ID NO: 197 - protein, 23 aa, Artificial Sequence
  Humanized C2 light chain variable framework region 1 (FWR1) acid sequence
DIVLTQSPASLAVSPGQRATITC

SEQ ID NO: 198 - DNA, 45 bp, Artificial Sequence
  Humanized C2 light chain variable complementarity determining regions 1 (CDR1) sequence
agagccagtaagagtgtcagtaccagcggatactcctacatgcac

SEQ ID NO: 199 - protein, 15 aa, Artificial Sequence
  Humanized C2 light chain variable complementarity determining regions 1 (CDR1) sequence
RASKSVSTSGYSYMH

SEQ ID NO: 200 - DNA, 45 bp, Artificial Sequence; identical to SEQ ID NO: 188
  Humanized C2 heavy light variable framework region 2 (FWR2) acid sequence

SEQ ID NO: 201 - protein, 15 aa, Artificial Sequence
  Humanized C2 heavy light variable framework region 2 (FWR2) acid sequence
WYQQKPGQPPKLLIY

SEQ ID NO: 202 - DNA, 21 bp, Artificial Sequence
  Humanized C2 light chain variable complementarity determining regions 2 (CDR2) sequence
ctggcatccaatctggagagc

SEQ ID NO: 203 - protein, 7 aa, Artificial Sequence
  Humanized C2 light chain variable complementarity determining regions 2 (CDR2) sequence
LASNLES

SEQ ID NO: 204 - DNA, 96 bp, Artificial Sequence; identical to SEQ ID NO: 192
  Humanized C2 light chain variable framework region 3 (FWR3) acid sequence

SEQ ID NO: 205 - protein, 32 aa, Artificial Sequence; identical to SEQ ID NO: 193
  Humanized C2 light chain variable framework region 3 (FWR3) acid sequence

SEQ ID NO: 206 - DNA, 27 bp, Artificial Sequence
  Humanized C2 light chain variable complementarity determining regions 3 (CDR3) sequence
cagcacagtagggagctgcctttcaca

SEQ ID NO: 207 - protein, 9 aa, Artificial Sequence
  Humanized C2 light chain variable complementarity determining regions 3 (CDR3) sequence
QHSRELPFT

SEQ ID NO: 208 - DNA, 27 bp, Artificial Sequence
  Humanized C2 light chain variable complementarity determining regions 3 (CDR3) sequence
ctgcagagtaagaattttcctcccaca

SEQ ID NO: 209 - protein, 9 aa, Artificial Sequence
  Humanized C2 light chain variable complementarity determining regions 3 (CDR3) sequence
LQSKNFPPT

SEQ ID NO: 210 - DNA, 813 bp, Artificial Sequence
  Humanized C2 gBLOCK#6 sequence (Kappa light chain in pCDNA3.1 V5)
actcactatagggagacccaagctggctagttaagcttgggccaccatggagacagacacactcctgctatgggtactgctgctctgggttccaggttccactggtgacgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaagtttaaacccgctgatcagcctcgactgtgccttctagttg

SEQ ID NO: 211 - DNA, 32 bp, Artificial Sequence; identical to SEQ ID NO: 161
  pCDNA3.1 V5 5' overlapping sequence

SEQ ID NO: 212 - DNA, 33 bp, Artificial Sequence; identical to SEQ ID NO: 64
  pCDNA3.1 V5 3' overlapping sequence

SEQ ID NO: 213 - DNA, 748 bp, Artificial Sequence
  Humanized C2 gBLOCK#7 sequence (Kappa light chain in pSEC Tag2)
tgctctgggttccaggttccactggtgacgcggcccagccggccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaagtttaaacccgctgatcagcctcgactgtgccttctagttg

SEQ ID NO: 214 - DNA, 31 bp, Artificial Sequence; identical to SEQ ID NO: 166
  pSEC Tag2 5' overlapping sequence

SEQ ID NO: 215 - DNA, 33 bp, Artificial Sequence; identical to SEQ ID NO: 64
  pSEC Tag2 3' overlapping sequence

SEQ ID NO: 216 - DNA, 813 bp, Artificial Sequence
  Humanized C2 gBLOCK#8 sequence (lambda light chain in pCDNA3.1 V5)
actcactatagggagacccaagctggctagttaagcttgggccaccatggagacagacacactcctgctatgggtactgctgctctgggttccaggttccactggtgacgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaagtttaaacccgctgatcagcctcgactgtgccttctagttg

SEQ ID NO: 217 - DNA, 32 bp, Artificial Sequence; identical to SEQ ID NO: 161
  pCDNA3.1 V5 5' overlapping sequence

SEQ ID NO: 218 - DNA, 33 bp, Artificial Sequence; identical to SEQ ID NO: 64
  pCDNA3.1 V5 3' overlapping sequence

SEQ ID NO: 219 - DNA, 748 bp, Artificial Sequence
  Humanized C2 gBLOCK#9 sequence (lambda light chain in pSEC Tag2)
tgctctgggttccaggttccactggtgacgcggcccagccggccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaagtttaaacccgctgatcagcctcgactgtgccttctagttg

SEQ ID NO: 220 - DNA, 31 bp, Artificial Sequence; identical to SEQ ID NO: 166
  pSEC Tag2 5' overlapping sequence

SEQ ID NO: 221 - DNA, 33 bp, Artificial Sequence; identical to SEQ ID NO: 64
  pSEC Tag2 3' overlapping sequence

SEQ ID NO: 222 - DNA, 63 bp, Artificial Sequence
  Murine Ig kappa chain leader sequence
atggagacagacacactcctgctatgggtactgctgctctgggttccaggttccactggtgac

SEQ ID NO: 223 - protein, 21 aa, Artificial Sequence
  Murine Ig kappa chain leader sequence
METDTLLLWVLLLWVPGSTGD

SEQ ID NO: 224 - DNA, 60 bp, Artificial Sequence
  Interleukin-2 (IL-2) leader sequence
atgtacaggatgcaactcctgtcttgcattgcactaagtcttgcacttgtcacaaacagt

SEQ ID NO: 225 - protein, 20 aa, Artificial Sequence
  Interleukin-2 (IL-2) leader sequence
MYRMQLLSCIALSLALVTNS

SEQ ID NO: 226 - DNA, 48 bp, Artificial Sequence
  CD33 leader sequence
atgcctcttctgcttctgcttcctctgctttgggctggagctcttgct

SEQ ID NO: 227 - protein, 16 aa, Artificial Sequence
  CD33 leader sequence
MPLLLLLPLLWAGALA

SEQ ID NO: 228 - DNA, 57 bp, Artificial Sequence
  IGHV3-21*03 leader sequence
atggaactggggctccgctgggttttccttgttgctattttagaaggtgtccagtgt

SEQ ID NO: 229 - protein, 19 aa, Artificial Sequence
  IGHV3-21*03 leader sequence
MELGLRWVFLVAILEGVQC

SEQ ID NO: 230 - DNA, 60 bp, Artificial Sequence
  IGHV3-11*02 leader sequence
atggaagccccagcgcagcttctcttcctcctgctactctggctcccagataccactgga

SEQ ID NO: 231 - protein, 20 aa, Artificial Sequence
  IGHV3-11*02 leader sequence
MEAPAQLLFLLLLWLPDTTG

SEQ ID NO: 232 - DNA, 729 bp, Artificial Sequence
  Humanized E6 single chain GS3
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 233 - protein, 243 aa, Artificial Sequence
  Humanized E6 single chain GS3
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 234 - DNA, 747 bp, Artificial Sequence
  Humanized E6 single chain IgG1noC
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcgataaaacccatactaaaccgccaaaaccggcgccggaactgctgggtggtcctggtaccggtgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 235 - protein, 249 aa, Artificial Sequence
  Humanized E6 single chain IgG1noC
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSDKTHTKPPKPAPELLGGPGTGEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 236 - DNA, 813 bp, Artificial Sequence
  Humanized E6 single chain X4 (linker is IgG1 and IgG2 modified hinge region)
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcgataaaacccatactaaaccgccaaaaccggcgccggaactgctgggtggtcctggtaccggtactggtggtccgactattaaacctccgaaacctccgaaacctgctccgaacctgctgggtggtccggaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 237 - protein, 271 aa, Artificial Sequence
  Humanized E6 single chain X4 (linker is IgG1 and IgG2 modified hinge region)
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSDKTHTKPPKPAPELLGGPGTGTGGPTIKPPKPPKPAPNLLGGPEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 238 - DNA, 747 bp, Artificial Sequence
  Humanized C2 single chain GS3
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaact

SEQ ID NO: 239 - protein, 249 aa, Artificial Sequence
  Humanized C2 single chain GS3
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRT

SEQ ID NO: 240 - DNA, 765 bp, Artificial Sequence
  Humanized C2 single chain IgG (no Cysteine)
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgataaaacccatactaaaccgccaaaaccggcgccggaactgctgggtggtcctggtaccggtgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaact

SEQ ID NO: 241 - protein, 255 aa, Artificial Sequence
  Humanized C2 single chain IgG (no Cysteine)
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSDKTHTKPPKPAPELLGGPGTGDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRT

SEQ ID NO: 242 - DNA, 831 bp, Artificial Sequence
  Humanized C2 single chain X4 (linker is IgG1 and IgG2 modified hinge region)
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgataaaacccatactaaaccgccaaaaccggcgccggaactgctgggtggtcctggtaccggtactggtggtccgactattaaacctccgaaacctccgaaacctgctccgaacctgctgggtggtccggacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaact

SEQ ID NO: 243 - protein, 277 aa, Artificial Sequence
  Humanized C2 single chain X4 (linker is IgG1 and IgG2 modified hinge region)
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSDKTHTKPPKPAPELLGGPGTGTGGPTIKPPKPPKPAPNLLGGPDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRT

SEQ ID NO: 244 - DNA, 744 bp, Artificial Sequence
  Humanized C3 single chain GS3
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcggcggtggcggatccggcggtggcggatccggcggtggcggatccgatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaact

SEQ ID NO: 245 - protein, 248 aa, Artificial Sequence
  Humanized C3 single chain GS3
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSGGGGSGGGGSGGGGSDIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRT

SEQ ID NO: 246 - DNA, 762 bp, Artificial Sequence
  Humanized C3 single chain IgG1 (no Cysteine)
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgataaaacccatactaaaccgccaaaaccggcgccggaactgctgggtggtcctggtaccggtgatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaact

SEQ ID NO: 247 - protein, 254 aa, Artificial Sequence
  Humanized C3 single chain IgG1 (no Cysteine)
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSDKTHTKPPKPAPELLGGPGTGDIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRT

SEQ ID NO: 248 - DNA, 828 bp, Artificial Sequence
  Humanized C3 single chain X4 (linker is IgG1 and IgG2 modified hinge region)
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgataaaacccatactaaaccgccaaaaccggcgccggaactgctgggtggtcctggtaccggtactggtggtccgactattaaacctccgaaacctccgaaacctgctccgaacctgctgggtggtccggatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaact

SEQ ID NO: 249 - protein, 276 aa, Artificial Sequence
  Humanized C3 single chain X4 (linker is IgG1 and IgG2 modified hinge region)
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSDKTHTKPPKPAPELLGGPGTGTGGPTIKPPKPPKPAPNLLGGPDIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRT

SEQ ID NO: 250 - DNA, 741 bp, Artificial Sequence
  Humanized C8 single chain GS3 (linker is [Gly4Ser1]3)
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccggcggtggcggatccggcggtggcggatccggcggtggcggatccgacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaact

SEQ ID NO: 251 - protein, 247 aa, Artificial Sequence
  Humanized C8 single chain GS3 (linker is [Gly4Ser1]3)
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSGGGGSGGGGSGGGGSDIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRT

SEQ ID NO: 252 - DNA, 759 bp, Artificial Sequence
  Humanized C8 single chain IgG1 (no Cysteine)
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccgataaaacccatactaaaccgccaaaaccggcgccggaactgctgggtggtcctggtaccggtgacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaact

SEQ ID NO: 253 - protein, 253 aa, Artificial Sequence
  Humanized C8 single chain IgG1 (no Cysteine)
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSDKTHTKPPKPAPELLGGPGTGDIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRT

SEQ ID NO: 254 - DNA, 825 bp, Artificial Sequence
  Humanized C8 single chain X4 (linker is IgG1 and IgG2 modified hinge region)
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactacccagactcagtgaagggccgattcaccatctccagagacaacgccaagaactcactgtatctgcaaatgaacagcctgagagccgaggacacggccgtgtattactgtgcgagactgggcggcgacaattactatgagtattggggcaaagggaccacggtcaccgtctcctccgataaaacccatactaaaccgccaaaaccggcgccggaactgctgggtggtcctggtaccggtactggtggtccgactattaaacctccgaaacctccgaaacctgctccgaacctgctgggtggtccggacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaact

SEQ ID NO: 255 - protein, 275 aa, Artificial Sequence
  Humanized C8 single chain X4 (linker is IgG1 and IgG2 modified hinge region)
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSDKTHTKPPKPAPELLGGPGTGTGGPTIKPPKPPKPAPNLLGGPDIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRT

SEQ ID NO: 256 - DNA, 1509 bp, Artificial Sequence
  pSECTag2 E6 scFV-FC
atggagacagacacactcctgctatgggtactgctgctctgggttccaggttccactggtgacgcggcccagccggccgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 257 - protein, 501 aa, Artificial Sequence
  pSECTag2 E6 scFV-FC
METDTLLLWVLLLWVPGSTGDAAQPAEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - DNA, 496 bp, Artificial Sequence
  E6 scFC-FC 1 gBLOCk sequence
tgctctgggttccaggttccactggtgacgcggcccagccggccgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtc

SEQ ID NO: 259 - DNA, 583 bp, Artificial Sequence
  E6 scFC-FC 2 gBLOCk sequence
aattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagc

SEQ ID NO: 260 - DNA, 1527 bp, Artificial Sequence
  pSECTag2 C2 scFV-FC
atggagacagacacactcctgctatgggtactgctgctctgggttccaggttccactggtgacgcggcccagccggccgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 261 - protein, 507 aa, Artificial Sequence
  pSECTag2 C2 scFV-FC
METDTLLLWVLLLWVPGSTGDAAQPAEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - DNA, 487 bp, Artificial Sequence
  C2 scFV-FC 1 gBLOCk sequence
tgctctgggttccaggttccactggtgacgcggcccagccggccgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggc

SEQ ID NO: 263 - DNA, 604 bp, Artificial Sequence
  C2 scFV-FC 2 gBLOCk sequence
cattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagc

SEQ ID NO: 264 - DNA, 1524 bp, Artificial Sequence
  pSECTag2 C3 scFV-FC
atggagacagacacactcctgctatgggtactgctgctctgggttccaggttccactggtgacgcggcccagccggcccaggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcggcggtggcggatccggcggtggcggatccggcggtggcggatccgatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 265 - protein, 506 aa, Artificial Sequence
  pSECTag2 C3 scFV-FC
METDTLLLWVLLLWVPGSTGDAAQPAQVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSGGGGSGGGGSGGGGSDIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - DNA, 480 bp, Artificial Sequence
  C3 GS scFV FC 1 gBLOCk sequence
tgctctgggttccaggttccactggtgacgcggcccagccggcccaggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcggcggtggcggatccggcggtggcggatccggcggtggcggatccgatattgtgatgacccagactccactctctctgt

SEQ ID NO: 267 - DNA, 607 bp, Artificial Sequence
  C3 scFV FC2 gBLOCk sequence
tattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagc

SEQ ID NO: 268 - DNA, 1521 bp, Artificial Sequence
  pSECTag2 C8 scFV-FC
atggagacagacacactcctgctatgggtactgctgctctgggttccaggttccactggtgacgcggcccagccggccgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccggcggtggcggatccggcggtggcggatccggcggtggcggatccgacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaactgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 269 - protein, 505 aa, Artificial Sequence
  pSECTag2 C8 scFV-FC
METDTLLLWVLLLWVPGSTGDAAQPAEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSGGGGSGGGGSGGGGSDIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRTEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - DNA, 477 bp, Artificial Sequence
  C8 scFV FC 1 gBLOCk sequence
tgctctgggttccaggttccactggtgacgcggcccagccggccgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccggcggtggcggatccggcggtggcggatccggcggtggcggatccgacatcgtgatgacccagtctccagactccctgg

SEQ ID NO: 271 - DNA, 607 bp, Artificial Sequence
  C8 scFV FC2 gBLOCk sequence
catcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaactgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagc

SEQ ID NO: 272 - DNA, 702 bp, Artificial Sequence
  Human IgG1 Fc sequence
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 273 - protein, 232 aa, Artificial Sequence
  Human IgG1 Fc sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 274 - DNA, 666 bp, Artificial Sequence
  Human IgG1 CH2-CH3 domain sequence
ccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 275 - protein, 220 aa, Artificial Sequence
  Human IgG1 CH2-CH3 domain sequence
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - DNA, 327 bp, Artificial Sequence
  Human IgG1 CH3 domain sequence
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 277 - protein, 107 aa, Artificial Sequence
  Human IgG1 CH3 domain sequence
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - DNA, 702 bp, Artificial Sequence
  Human IgG1 Fc Y407R sequence
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctcaggagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 279 - protein, 232 aa, Artificial Sequence
  Human IgG1 Fc Y407R sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLRSKLTVDKSRWQQGNVFSCSVMHEALHNHYTQKSLSLSPGK

SEQ ID NO: 280 - DNA, 702 bp, Artificial Sequence
  Human IgG1 Fc F405Q sequence
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttccagctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 281 - protein, 232 aa, Artificial Sequence
  Human IgG1 Fc F405Q sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFQLYSKLTVDKSRWQQGNVFSCSVMHEALHNHYTQKSLSLSPGK

SEQ ID NO: 282 - DNA, 702 bp, Artificial Sequence
  Human IgG1 Fc T394D sequence
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccgaccctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 283 - protein, 232 aa, Artificial Sequence
  Human IgG1 Fc T394D sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTDPPVLDSDGSFFLYSKLTVDKSRWQQGNVFSCSVMHEALHNHYTQKSLSLSPGK

SEQ ID NO: 284 - DNA, 702 bp, Artificial Sequence
  Human IgG1 Fc T366W/L368W sequence
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgtggtgctgggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 285 - protein, 232 aa, Artificial Sequence
  Human IgG1 Fc T366W/L368W sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCWVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - DNA, 702 bp, Artificial Sequence
  Human IgG1 Fc T364R/L368R sequence
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcaggctgacctgcagggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 287 - protein, 232 aa, Artificial Sequence
  Human IgG1 Fc T364R/L368R sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVRLTCRVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - DNA, 657 bp, Artificial Sequence
  Human IgG1 Fc hingeless sequence
gcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 289 - protein, 217 aa, Artificial Sequence
  Human IgG1 Fc hingeless sequence
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - DNA, 696 bp, Artificial Sequence
  Human IgG1 G237A FC sequence
gagcccaaatcttgtgacaaaactcacacatgcccaccgtgcccagcacctgaactcctgggggccccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 291 - protein, 232 aa, Artificial Sequence
  Human IgG1 G237A FC sequence
EPKSCDKTHTCPPCPAPELLGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - DNA, 696 bp, Artificial Sequence
  Human IgG1 L234A/L235A FC sequence
gagcccaaatcttgtgacaaaactcacacatgcccaccgtgcccagcacctgaagccgccgggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 293 - protein, 232 aa, Artificial Sequence
  Human IgG1 L234A/L235A FC sequence
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - DNA, 1341 bp, Artificial Sequence
  CAR-T E6 CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 295 - protein, 445 aa, Artificial Sequence
  CAR-T E6 CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - DNA, 485 bp, Artificial Sequence
  CAR-T E6 CD3z gBLOCK sequence
tggagctgtgcacacaagaggactggatttcgcctgtgatatctacatttgggccccgctcgcaggcacatgtggagtgctcctcctctccctggtgattaccctgtactgccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataagtttaaacccgctgatcagcctcgactgtgc

SEQ ID NO: 297 - DNA, 1464 bp, Artificial Sequence
  CAR-T E6 CD28/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 298 - protein, 486 aa, Artificial Sequence
  CAR-T E6 CD28/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 299 - DNA, 608 bp, Artificial Sequence
  CAR-T E6 CD28/CD3z g BLOCK sequence
tggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataagtttaaacccgctgatcagcctcgactgtgc

SEQ ID NO: 300 - DNA, 1467 bp, Artificial Sequence
  CAR-T E6 4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 301 - protein, 487 aa, Artificial Sequence
  CAR-T E6 4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - DNA, 611 bp, Artificial Sequence
  CAR-T E6 4-1BB/CD3z gBLOCK sequence
tggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataagtttaaacccgctgatcagcctcgactgtgc

SEQ ID NO: 303 - DNA, 1590 bp, Artificial Sequence
  CAR-T E6 CD28/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtccaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 304 - protein, 528 aa, Artificial Sequence
  CAR-T E6 CD28/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 305 - DNA, 1668 bp, Artificial Sequence
  CAR-T E6 CD28/4-1BB/CD3z gBLOCK sequence
atagggagacccaagctggctagttaagcttggtaccgagggccaccatggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtccaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataagtttaaacccgctgatcagcctcgactgtgc

SEQ ID NO: 306 - DNA, 1608 bp, Artificial Sequence
  CAR-T C2 CD28/4-1BB/CD3z sequence
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtccaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 307 - protein, 513 aa, Artificial Sequence
  CAR-T C2 CD28/4-1BB/CD3z sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 308 - DNA, 553 bp, Artificial Sequence
  CAR-T C2-1 gBLOCK sequence
atagggagacccaagctggctagttaagcttggtaccgagggccaccatggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggc

SEQ ID NO: 309 - DNA, 518 bp, Artificial Sequence
  CAR-T C2-2 gBLOCK sequence
aagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgc

SEQ ID NO: 310 - DNA, 2028 bp, Artificial Sequence
  CAR E6 Fc/8/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 311 - protein, 674 aa, Artificial Sequence
  CAR E6 Fc/8/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 312 - DNA, 714 bp, Artificial Sequence
  E6 CAR pCDH gBLOCK sequence
acgctgttttgacctccatagaagattctagagctagctgtagagcttggtaccgagggccaccatggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgc

SEQ ID NO: 313 - DNA, 723 bp, Artificial Sequence
  E6 CAR Fc pCDH gBLOCK sequence
agtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctg

SEQ ID NO: 314 - DNA, 778 bp, Artificial Sequence
  E6 CAR 8BB3 pCDH gBLOCK sequence
agaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataagtttaaacccgctgatcaggcggccgcgaaggatctgcgatcgctccggtgcccgtcag

SEQ ID NO: 315 - DNA, 1983 bp, Artificial Sequence
  CAR E6 FcH/8/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 316 - protein, 659 aa, Artificial Sequence
  CAR E6 FcH/8/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 317 - DNA, 678 bp, Artificial Sequence
  E6 CAR FcH pCDH gBLOCK sequence
agtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctg

SEQ ID NO: 318 - DNA, 2022 bp, Artificial Sequence
  CAR E6 Fc/4/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaatggccctgattgtgctggggggcgtcgccggcctcctgcttttcattgggctaggcatcttcttcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 319 - protein, 672 aa, Artificial Sequence
  CAR E6 Fc/4/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKMALIVLGGVAGLLLFIGLGIFFKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 320 - DNA, 772 bp, Artificial Sequence
  E6 CAR 44BB3 pCDH gBLOCK sequence
agaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaatggccctgattgtgctggggggcgtcgccggcctcctgcttttcattgggctaggcatcttcttcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataagtttaaacccgctgatcaggcggccgcgaaggatctgcgatcgctccggtgcccgtcag

SEQ ID NO: 321 - DNA, 1977 bp, Artificial Sequence
  CAR E6 FcH/4/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaatggccctgattgtgctggggggcgtcgccggcctcctgcttttcattgggctaggcatcttcttcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 322 - protein, 657 aa, Artificial Sequence
  CAR E6 FcH/4/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKMALIVLGGVAGLLLFIGLGIFFKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 323 - DNA, 1506 bp, Artificial Sequence
  CAR E6 IgD/8/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagagtctccaaaggcacaggcctcctcagtgcccactgcacaaccccaagcagagggcagcctcgccaaggcaaccacagccccagccaccacccgtaacacaggaagaggcggcgaagagaagaaaaaggagaaggagaaagaggaacaagaagagagagagacaaagacaccaatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 324 - protein, 500 aa, Artificial Sequence
  CAR E6 IgD/8/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKESPKAQASSVPTAQPQAEGSLAKATTAPATTRNTGRGGEEKKKEKEKEEQEERETKTPIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - DNA, 475 bp, Artificial Sequence
  E6 CAR IgD8 pcDH gBLOCK sequence
agtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagagtctccaaaggcacaggcctcctcagtgcccactgcacaaccccaagcagagggcagcctcgccaaggcaaccacagccccagccaccacccgtaacacaggaagaggcggcgaagagaagaaaaaggagaaggagaaagaggaacaagaagagagagagacaaagacaccaatctacatttgggccccgctcgcaggcacatgtggagtgctcctcctctccctggtgattaccctgtactgcaaaaggggccgcaaaaaactcctttacatttttaagcagccttttatgaggccag

SEQ ID NO: 326 - DNA, 502 bp, Artificial Sequence
  E6 CAR BB 3 pCDH gBLOCK sequence
acatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataagtttaaacccgctgatcaggcggccgcgaaggatctgcgatcgctccggtgcccgtcag

SEQ ID NO: 327 - DNA, 1500 bp, Artificial Sequence
  CAR E6 IgD/4/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagagtctccaaaggcacaggcctcctcagtgcccactgcacaaccccaagcagagggcagcctcgccaaggcaaccacagccccagccaccacccgtaacacaggaagaggcggcgaagagaagaaaaaggagaaggagaaagaggaacaagaagagagagagacaaagacaccaatggccctgattgtgctggggggcgtcgccggcctcctgcttttcattgggctaggcatcttcttcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 328 - protein, 498 aa, Artificial Sequence
  CAR E6 IgD/4/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKESPKAQASSVPTAQPQAEGSLAKATTAPATTRNTGRGGEEKKKEKEKEEQEERETKTPMALIVLGGVAGLLLFIGLGIFFKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 329 - DNA, 469 bp, Artificial Sequence
  E6 CAR IgD4 pcDH gBLOCK sequence
agtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagagtctccaaaggcacaggcctcctcagtgcccactgcacaaccccaagcagagggcagcctcgccaaggcaaccacagccccagccaccacccgtaacacaggaagaggcggcgaagagaagaaaaaggagaaggagaaagaggaacaagaagagagagagacaaagacaccaatggccctgattgtgctggggggcgtcgccggcctcctgcttttcattgggctaggcatcttcttcaaaaggggccgcaaaaaactcctttacatttttaagcagccttttatgaggccag

SEQ ID NO: 330 - DNA, 1461 bp, Artificial Sequence
  CAR E6 X4/8/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagacaagacgcacaccaagccacctaaaccagctccagaactgctcggaggtcctggcaccggaaccggaggacctaccatcaaaccacctaagccacctaagcctgctcctaacctgctcggaggacctatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 331 - protein, 485 aa, Artificial Sequence
  CAR E6 X4/8/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKDKTHTKPPKPAPELLGGPGTGTGGPTIKPPKPPKPAPNLLGGPIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 332 - DNA, 430 bp, Artificial Sequence
  E6 CAR X48 pCDH gBLOCK sequence
agtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagacaagacgcacaccaagccacctaaaccagctccagaactgctcggaggtcctggcaccggaaccggaggacctaccatcaaaccacctaagccacctaagcctgctcctaacctgctcggaggacctatctacatttgggccccgctcgcaggcacatgtggagtgctcctcctctccctggtgattaccctgtactgcaaaaggggccgcaaaaaactcctttacatttttaagcagccttttatgaggccag

SEQ ID NO: 333 - DNA, 1455 bp, Artificial Sequence
  CAR E6 X4/4/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagacaagacgcacaccaagccacctaaaccagctccagaactgctcggaggtcctggcaccggaaccggaggacctaccatcaaaccacctaagccacctaagcctgctcctaacctgctcggaggacctatggccctgattgtgctggggggcgtcgccggcctcctgcttttcattgggctaggcatcttcttcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 334 - protein, 483 aa, Artificial Sequence
  CAR E6 X4/4/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKDKTHTKPPKPAPELLGGPGTGTGGPTIKPPKPPKPAPNLLGGPMALIVLGGVAGLLLFIGLGIFFKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 335 - DNA, 424 bp, Artificial Sequence
  E6 CAR X44 pCDH gBLOCK sequence
agtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaagacaagacgcacaccaagccacctaaaccagctccagaactgctcggaggtcctggcaccggaaccggaggacctaccatcaaaccacctaagccacctaagcctgctcctaacctgctcggaggacctatggccctgattgtgctggggggcgtcgccggcctcctgcttttcattgggctaggcatcttcttcaaaaggggccgcaaaaaactcctttacatttttaagcagccttttatgaggccag

SEQ ID NO: 336 - DNA, 1461 bp, Artificial Sequence
  CAR E6 8+4/4/4-1BB/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggcggaggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatggccctgattgtgctggggggcgtcgccggcctcctgcttttcattgggctaggcatcttcttcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 337 - protein, 485 aa, Artificial Sequence
  CAR E6 8+4/4/4-1BB/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDMALIVLGGVAGLLLFIGLGIFFKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 338 - DNA, 430 bp, Artificial Sequence
  E6 CAR CD844 pCDH gBLOCK sequence
agtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatggccctgattgtgctggggggcgtcgccggcctcctgcttttcattgggctaggcatcttcttcaaaaggggccgcaaaaaactcctttacatttttaagcagccttttatgaggccag

SEQ ID NO: 339 - DNA, 820 bp, Artificial Sequence
  Humanized C2 scFV sequence in CAR
gagggccaccatggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaacc

SEQ ID NO: 340 - protein, 249 aa, Artificial Sequence; identical to SEQ ID NO: 239
  Humanized C2 scFV sequence in CAR

SEQ ID NO: 341 - DNA, 729 bp, Artificial Sequence
  Humanized E6 scFV sequence in CAR
gaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaa

SEQ ID NO: 342 - protein, 243 aa, Artificial Sequence; identical to SEQ ID NO: 233
  Humanized E6 scFV sequence in CAR

SEQ ID NO: 343 - DNA, 63 bp, Artificial Sequence
  CD8 leader sequence
atggccctgcccgtgaccgctttgctgctccccctggcgctgctgctgcacgccgccaggcca

SEQ ID NO: 344 - protein, 21 aa, Artificial Sequence
  CD8 leader sequence
MALPVTALLLPLALLLHAARP

SEQ ID NO: 345 - DNA, 135 bp, Artificial Sequence
  CD8 hinge domain sequence
acgacaaccccggcccccagaccaccaacgccagcccccaccatcgccagccaacccctgtctctgagaccagaagcctgtaggcctgccgccggtggagctgtgcacacaagaggactggatttcgcctgtgat

SEQ ID NO: 346 - protein, 45 aa, Artificial Sequence
  CD8 hinge domain sequence
TTTPAPRPPTPAPTIASQPLSLRPEACRPAAGGAVHTRGLDFACD

SEQ ID NO: 347 - DNA, 66 bp, Artificial Sequence
  CD4 hinge domain sequence
tcgggacaggtcctgctggaatccaacatcaaggttctgcccacatggtccaccccggtgcagcca

SEQ ID NO: 348 - protein, 22 aa, Artificial Sequence
  CD4 hinge domain sequence
SGQVLLESNIKVLPTWSTPVQP

SEQ ID NO: 349 - DNA, 45 bp, Artificial Sequence
  CD28 hinge domain sequence
aaacacctttgtccaagtcccctatttcccggaccttctaagccc

SEQ ID NO: 350 - protein, 15 aa, Artificial Sequence
  CD28 hinge domain sequence
KHLCPSPLFPGPSKP

SEQ ID NO: 351 - DNA, 201 bp, Artificial Sequence
  CD8+CD4 hinge domain sequence
acgacaaccccggcccccagaccaccaacgccagcccccaccatcgccagccaacccctgtctctgagaccagaagcctgtaggcctgccgccggtggagctgtgcacacaagaggactggatttcgcctgtgattcgggacaggtcctgctggaatccaacatcaaggttctgcccacatggtccaccccggtgcagcca

SEQ ID NO: 352 - protein, 67 aa, Artificial Sequence
  CD8+CD4 hinge domain sequence
TTTPAPRPPTPAPTIASQPLSLRPEACRPAAGGAVHTRGLDFACDSGQVLLESNIKVLPTWSTPVQP

SEQ ID NO: 353 - DNA, 180 bp, Artificial Sequence
  CD8+CD28 hinge domain sequence
acgacaaccccggcccccagaccaccaacgccagcccccaccatcgccagccaacccctgtctctgagaccagaagcctgtaggcctgccgccggtggagctgtgcacacaagaggactggatttcgcctgtgataaacacctttgtccaagtcccctatttcccggaccttctaagccc

SEQ ID NO: 354 - protein, 60 aa, Artificial Sequence
  CD8+CD28 hinge domain sequence
TTTPAPRPPTPAPTIASQPLSLRPEACRPAAGGAVHTRGLDFACDKHLCPSPLFPGPSKP

SEQ ID NO: 355 - DNA, 111 bp, Artificial Sequence
  CD28+CD4 hinge domain sequence
aaacacctttgtccaagtcccctatttcccggaccttctaagccctcgggacaggtcctgctggaatccaacatcaaggttctgcccacatggtccaccccggtgcagcca

SEQ ID NO: 356 - protein, 37 aa, Artificial Sequence
  CD28+CD4 hinge domain sequence
KHLCPSPLFPGPSKPSGQVLLESNIKVLPTWSTPVQP

SEQ ID NO: 357 - DNA, 174 bp, Artificial Sequence
  Human IgD hinge domain sequence
gagtctccaaaggcacaggcctcctcagtgcccactgcacaaccccaagcagagggcagcctcgccaaggcaaccacagccccagccaccacccgtaacacaggaagaggcggcgaagagaagaaaaaggagaaggagaaagaggaacaagaagagagagagacaaagacacca

SEQ ID NO: 358 - protein, 58 aa, Artificial Sequence
  Human IgD hinge domain sequence
ESPKAQASSVPTAQPQAEGSLAKATTAPATTRNTGRGGEEKKKEKEKEEQEERETKTP

SEQ ID NO: 359 - DNA, 129 bp, Artificial Sequence
  X4 linker (IgG1 and IgG2 modified hinge region) sequence
gacaagacgcacaccaagccacctaaaccagctccagaactgctcggaggtcctggcaccggaaccggaggacctaccatcaaaccacctaagccacctaagcctgctcctaacctgctcggaggacct

SEQ ID NO: 360 - protein, 43 aa, Artificial Sequence
  X4 linker (IgG1 and IgG2 modified hinge region) sequence
DKTHTKPPKPAPELLGGPGTGTGGPTIKPPKPPKPAPNLLGGP

SEQ ID NO: 361 - DNA, 63 bp, Artificial Sequence
  CD3 zeta transmembrane domain sequence
ctctgctacctgctggatggaatcctcttcatctatggtgtcattctcactgccttgttcctg

SEQ ID NO: 362 - protein, 21 aa, Artificial Sequence
  CD3 zeta transmembrane domain sequence
LCYLLDGILFIYGVILTALFL

SEQ ID NO: 363 - DNA, 72 bp, Artificial Sequence
  CD8 transmembrane domain sequence
atctacatttgggccccgctcgcaggcacatgtggagtgctcctcctctccctggtgattaccctgtactgc

SEQ ID NO: 364 - protein, 24 aa, Artificial Sequence
  CD8 transmembrane domain sequence
IYIWAPLAGTCGVLLLSLVITLYC

SEQ ID NO: 365 - DNA, 66 bp, Artificial Sequence
  CD4 transmembrane domain sequence
atggccctgattgtgctggggggcgtcgccggcctcctgcttttcattgggctaggcatcttcttc

SEQ ID NO: 366 - protein, 22 aa, Artificial Sequence
  CD4 transmembrane domain sequence
MALIVLGGVAGLLLFIGLGIFF

SEQ ID NO: 367 - DNA, 81 bp, Artificial Sequence
  CD28 transmembrane domain sequence
ttttgggtgctggtggtggttggtggagtcctggcttgctatagcttgctagtaacagtggcctttattattttctgggtg

SEQ ID NO: 368 - protein, 27 aa, Artificial Sequence
  CD28 transmembrane domain sequence
FWVLVVVGGVLACYSLLVTVAFIIFWV

SEQ ID NO: 369 - DNA, 81 bp, Artificial Sequence
  4-1BB transmembrane domain sequence
atcatctccttctttcttgcgctgacgtcgactgcgttgctcttcctgctgttcttcctcacgctccgtttctctgttgtt

SEQ ID NO: 370 - protein, 27 aa, Artificial Sequence
  4-1BB transmembrane domain sequence
IISFFLALTSTALLFLLFFLTLRFSVV

SEQ ID NO: 371 - DNA, 78 bp, Artificial Sequence
  OX40 transmembrane domain sequence
gttgccgccatcctgggcctgggcctggtgctggggctgctgggccccctggccatcctgctggccctgtacctgctc

SEQ ID NO: 372 - protein, 26 aa, Artificial Sequence
  OX40 transmembrane domain sequence
VAAILGLGLVLGLLGPLAILLALYLL

SEQ ID NO: 373 - DNA, 336 bp, Artificial Sequence
  CD3 zeta domain sequence
cgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacgg

SEQ ID NO: 374 - protein, 112 aa, Artificial Sequence
  CD3 zeta domain sequence
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 375 - DNA, 336 bp, Artificial Sequence
  CD3 zeta domain variant sequence
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 376 - protein, 112 aa, Artificial Sequence
  CD3 zeta domain variant sequence
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 377 - DNA, 123 bp, Artificial Sequence
  CD28 domain sequence
agaagcaagcggtctcggctcctgcattctgattacatgaacatgaccccaagaagaccaggccccaccaggaaacattaccagccctacgctccgccacgcgacttcgctgcctaccggtcc

SEQ ID NO: 378 - protein, 41 aa, Artificial Sequence
  CD28 domain sequence
RSKRSRLLHSDYMNMTPRRPGPTRKHYQPYAPPRDFAAYRS

SEQ ID NO: 379 - DNA, 126 bp, Artificial Sequence
  4-1BB domain sequence
aaaaggggccgcaaaaaactcctttacatttttaagcagccttttatgaggccagtacagacgactcaagaggaagacgggtgctcatgccgctttcctgaggaggaggaaggagggtgcgaactg

SEQ ID NO: 380 - protein, 42 aa, Artificial Sequence
  4-1BB domain sequence
KRGRKKLLYIFKQPFMRPVQTTQEEDGCSCRFPEEEEGGCEL

SEQ ID NO: 381 - DNA, 111 bp, Artificial Sequence
  OX40 domain sequence
cggagggaccagaggctgccccccgatgcccacaagccccctgggggaggcagtttccggacccccatccaagaggagcaggccgacgcccactccaccctggccaagatc

SEQ ID NO: 382 - protein, 37 aa, Artificial Sequence
  OX40 domain sequence
RRDQRLPPDAHKPPGGGSFRTPIQEEQADAHSTLAKI

SEQ ID NO: 383 - DNA, 723 bp, Artificial Sequence
  Humanized anti CD3 scFV clone 12F6 (VH-VL) sequence
caggtgcagctggtgcagagcggaggtggagtggtccaacctggaagatctctgagactgagctgtaaggctagcgggtacacgttcacatcttacacgatgcactgggtgaggcaagcccccggtaagggcctggaatggatcggatatataaaccccagctcagggtataccaaatataatcagaagttcaaagatcggttcacgatttctgctgataaaagtaagtccaccgctttcctgcagatggactcactcaggccagaagatactggtgtttatttctgtgcaaggtggcaggactacgacgtgtactttgactattgggggcaggggacgcctgtaacagtatcaagcggcggtggcggatccggcggtggcggatccggcggtggcggatccgatattcagatgacccagagcccgagcagcctgagcgcgagcgtgggcgatcgcgtgaccatgacctgccgcgcgagcagcagcgtgagctatatgcattggtatcagcagaccccgggcaaagcgccgaaaccgtggatttatgcgaccagcaacctggcgagcggcgtgccgagccgctttagcggcagcggcagcggcaccgattataccctgaccattagcagcctgcagccggaagatattgcgacctattattgccagcagtggagcagcaacccgccgacctttggccagggcaccaaactgcagattacccgc

SEQ ID NO: 384 - protein, 241 aa, Artificial Sequence
  Humanized anti CD3 scFV clone 12F6 (VH-VL) sequence
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSSGGGGSGGGGSGGGGSDIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 385 - DNA, 723 bp, Artificial Sequence
  Humanized anti CD3 scFV clone 12F6 (VL-VH) sequence
gatattcagatgacccagagcccgagcagcctgagcgcgagcgtgggcgatcgcgtgaccatgacctgccgcgcgagcagcagcgtgagctatatgcattggtatcagcagaccccgggcaaagcgccgaaaccgtggatttatgcgaccagcaacctggcgagcggcgtgccgagccgctttagcggcagcggcagcggcaccgattataccctgaccattagcagcctgcagccggaagatattgcgacctattattgccagcagtggagcagcaacccgccgacctttggccagggcaccaaactgcagattacccgcggcggtggcggatccggcggtggcggatccggcggtggcggatcccaggtgcagctggtgcagagcggaggtggagtggtccaacctggaagatctctgagactgagctgtaaggctagcgggtacacgttcacatcttacacgatgcactgggtgaggcaagcccccggtaagggcctggaatggatcggatatataaaccccagctcagggtataccaaatataatcagaagttcaaagatcggttcacgatttctgctgataaaagtaagtccaccgctttcctgcagatggactcactcaggccagaagatactggtgtttatttctgtgcaaggtggcaggactacgacgtgtactttgactattgggggcaggggacgcctgtaacagtatcaagc

SEQ ID NO: 386 - protein, 241 aa, Artificial Sequence
  Humanized anti CD3 scFV clone 12F6 (VL-VH) sequence
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITRGGGGSGGGGSGGGGSQVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 387 - DNA, 723 bp, Artificial Sequence
  Humanized anti CD3 scFV clone OKT3 (VH-VL) sequence
caggtgcagctggtgcagagcggaggcggagtggtgcagcctggaagaagcctgcgcctgagctgcaaagcgagcggctatacctttacccgctataccatgcattgggtgcgccaggcgccgggcaaaggcctggaatggattggctatattaacccgagccgcggctataccaactataaccagaaagtgaaagatcgctttaccattagcaccgataaaagcaaaagcaccgcgtttctgcagatggatagcctgcgcccggaagataccgcggtgtattattgcgcgcgctattatgatgatcattattgcctggattattggggccagggcaccaccctgaccgtgagcagcggcggtggcggatccggcggtggcggatccggcggtggcggatccgatattcagatgacccagagcccgagcagcctgagcgcgagcgtgggcgatcgcgtgaccattacctgcagcgcgagcagcagcgtgagctatatgaactggtatcagcagaccccgggcaaagcgccgaaacgctggatttatgataccagcaaactggcgagcggcgtgccgagccgctttagcggcagcggcagcggcaccgattatacctttaccattagcagcctgcagccggaagatattgcgacctattattgccagcagtggagcagcaacccgtttacctttggccagggcaccaaactgcagattacccgc

SEQ ID NO: 388 - protein, 241 aa, Artificial Sequence
  Humanized anti CD3 scFV clone OKT3 (VH-VL) sequence
QVQLVQSGGGVVQPGRSLRLSCKASGYTFTRYTMHWVRQAPGKGLEWIGYINPSRGYTNYNQKVKDRFTISTDKSKSTAFLQMDSLRPEDTAVYYCARYYDDHYCLDYWGQGTTLTVSSGGGGSGGGGSGGGGSDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 389 - DNA, 723 bp, Artificial Sequence
  Humanized anti CD3 scFV clone OKT3 (VH-VL) sequence
gatattcagatgacccagagcccgagcagcctgagcgcgagcgtgggcgatcgcgtgaccattacctgcagcgcgagcagcagcgtgagctatatgaactggtatcagcagaccccgggcaaagcgccgaaacgctggatttatgataccagcaaactggcgagcggcgtgccgagccgctttagcggcagcggcagcggcaccgattatacctttaccattagcagcctgcagccggaagatattgcgacctattattgccagcagtggagcagcaacccgtttacctttggccagggcaccaaactgcagattacccgcggcggtggcggatccggcggtggcggatccggcggtggcggatcccaggtgcagctggtgcagagcggaggcggagtggtgcagcctggaagaagcctgcgcctgagctgcaaagcgagcggctatacctttacccgctataccatgcattgggtgcgccaggcgccgggcaaaggcctggaatggattggctatattaacccgagccgcggctataccaactataaccagaaagtgaaagatcgctttaccattagcaccgataaaagcaaaagcaccgcgtttctgcagatggatagcctgcgcccggaagataccgcggtgtattattgcgcgcgctattatgatgatcattattgcctggattattggggccagggcaccaccctgaccgtgagcagc

SEQ ID NO: 390 - protein, 241 aa, Artificial Sequence
  Humanized anti CD3 scFV clone OKT3 (VH-VL) sequence
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGGGSGGGGSGGGGSQVQLVQSGGGVVQPGRSLRLSCKASGYTFTRYTMHWVRQAPGKGLEWIGYINPSRGYTNYNQKVKDRFTISTDKSKSTAFLQMDSLRPEDTAVYYCARYYDDHYCLDYWGQGTTLTVSS

SEQ ID NO: 391 - DNA, 729 bp, Artificial Sequence; identical to SEQ ID NO: 232
  HumanizeE6 scFV (VH-VL) sequence

SEQ ID NO: 392 - protein, 243 aa, Artificial Sequence; identical to SEQ ID NO: 233
  HumanizeE6 scFV (VH-VL) sequence

SEQ ID NO: 393 - DNA, 729 bp, Artificial Sequence
  HumanizeE6 scFV (VL-VH) sequence
gaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaggcggtggcggatccggcggtggcggatccggcggtggcggatccgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagc

SEQ ID NO: 394 - protein, 243 aa, Artificial Sequence
  HumanizeE6 scFV (VL-VH) sequence
EIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKGGGGSGGGGSGGGGSEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSS

SEQ ID NO: 395 - DNA, 747 bp, Artificial Sequence; identical to SEQ ID NO: 238
  HumanizeC2 scFV (VH-VL) sequence

SEQ ID NO: 396 - protein, 249 aa, Artificial Sequence; identical to SEQ ID NO: 239
  HumanizeC2 scFV (VH-VL) sequence

SEQ ID NO: 397 - DNA, 747 bp, Artificial Sequence
  HumanizeE6 scFV (VL-VH) sequence
gacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactggcggtggcggatccggcggtggcggatccggcggtggcggatccgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctcc

SEQ ID NO: 398 - protein, 249 aa, Artificial Sequence
  HumanizeE6 scFV (VL-VH) sequence
DIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTGGGGSGGGGSGGGGSEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSS

SEQ ID NO: 399 - DNA, 15 bp, Artificial Sequence
  G4S1 linker sequence
ggcggtggcggatcc

SEQ ID NO: 400 - protein, 5 aa, Artificial Sequence
  G4S1 linker sequence
GGGGS

SEQ ID NO: 401 - DNA, 45 bp, Artificial Sequence
  [G4S1]x3 linker sequence
ggcggtggcggatccggcggtggcggatccggcggtggcggatcc

SEQ ID NO: 402 - protein, 15 aa, Artificial Sequence
  [G4S1]x3 linker sequence
GGGGSGGGGSGGGGS

SEQ ID NO: 403 - DNA, 24 bp, Artificial Sequence
  8 aa GS linker sequence
ggcggttccggcggtggatccgga

SEQ ID NO: 404 - protein, 8 aa, Artificial Sequence
  8 aa GS linker sequence
GGSGGGSG

SEQ ID NO: 405 - DNA, 39 bp, Artificial Sequence
  12 aa GS linker sequence
ggcggttccggcggtggatccggcggtggcggatccgga

SEQ ID NO: 406 - protein, 12 aa, Artificial Sequence
  12 aa GS linker sequence
GGSGGGSGGGSG

SEQ ID NO: 407 - DNA, 39 bp, Artificial Sequence
  13 aa GS linker sequence
ggcggtggatccggcggtggcggatccggcggtggatcc

SEQ ID NO: 408 - protein, 13 aa, Artificial Sequence
  13 aa GS linker sequence
GGGSGGGGSGGGS

SEQ ID NO: 409 - DNA, 66 bp, Artificial Sequence
  22 aa GS linker sequence
ggcggtggaagcggcggtggcggatccggcagcggcggaagcggcggtggcggatccggcggtgga

SEQ ID NO: 410 - protein, 22 aa, Artificial Sequence
  22 aa GS linker sequence
GGGSGGGGSGSGGSGGGGSGGG

SEQ ID NO: 411 - DNA, 78 bp, Artificial Sequence
  24 aa GS linker sequence
ggcggttccggcggtggatccggcggtggcggatccggaggcggttccggcggtggatccggcggtggcggatccgga

SEQ ID NO: 412 - protein, 24 aa, Artificial Sequence
  24 aa GS linker sequence
GGSGGGSGGGSGGGSGGGSGGGSG

SEQ ID NO: 413 - DNA, 357 bp, Artificial Sequence
  Mouse C3 Heavy chain variable region sequence
caggtccagctgcagcagtctgggcctgagctggtgaggcctggggtctcagtgaagatttcctgcaagggttccggctacagattcactgattatgctatgaactgggtgaagcagagtcatgcaaagagtctagagtggattggagttattagtactttctctggtaatacaaacttcaaccagaagtttaagggcaaggccacaatgactgtagacaaatcctccagcacagcctatatggaacttgccagattgacatctgaggattctgccatgtattactgtgcaagatcggattactacggcccatactttgactactggggccaaggcaccactctcacagtctcctca

SEQ ID NO: 414 - protein, 119 aa, Artificial Sequence
  Mouse C3 Heavy chain variable region sequence
QVQLQQSGPELVRPGVSVKISCKGSGYRFTDYAMNWVKQSHAKSLEWIGVISTFSGNTNFNQKFKGKATMTVDKSSSTAYMELARLTSEDSAMYYCARSDYYGPYFDYWGQGTTLTVSS

SEQ ID NO: 415 - DNA, 90 bp, Artificial Sequence
  Mouse C3 heavy chain variable framework region 1 (FWR1) sequence
caggtccagctgcagcagtctgggcctgagctggtgaggcctggggtctcagtgaagatttcctgcaagggttccggctacagattcact

SEQ ID NO: 416 - protein, 30 aa, Artificial Sequence
  Mouse C3 heavy chain variable framework region 1 (FWR1) sequence
QVQLQQSGPELVRPGVSVKISCKGSGYRFT

SEQ ID NO: 417 - DNA, 15 bp, Artificial Sequence
  Mouse C3 heavy chain variable complementarity determining regions 1 (CDR1) sequence
gattatgctatgaac

SEQ ID NO: 418 - protein, 5 aa, Artificial Sequence
  Mouse C3 heavy chain variable complementarity determining regions 1 (CDR1) sequence
DYAMN

SEQ ID NO: 419 - DNA, 42 bp, Artificial Sequence
  Mouse C3 heavy chain variable framework region 2 (FWR2) sequence
tgggtgaagcagagtcatgcaaagagtctagagtggattgga

SEQ ID NO: 420 - protein, 14 aa, Artificial Sequence
  Mouse C3 heavy chain variable framework region 2 (FWR2) sequence
WVKQSHAKSLEWIG

SEQ ID NO: 421 - DNA, 51 bp, Artificial Sequence
  Mouse C3 heavy chain variable complementarity determining regions 2 (CDR2) sequence
gttattagtactttctctggtaatacaaacttcaaccagaagtttaagggc

SEQ ID NO: 422 - protein, 17 aa, Artificial Sequence
  Mouse C3 heavy chain variable complementarity determining regions 2 (CDR2) sequence
VISTFSGNTNFNQKFKG

SEQ ID NO: 423 - DNA, 96 bp, Artificial Sequence
  Mouse C3 heavy chain variable framework region 3 (FWR3) acid sequence
aaggccacaatgactgtagacaaatcctccagcacagcctatatggaacttgccagattgacatctgaggattctgccatgtattactgtgcaaga

SEQ ID NO: 424 - protein, 32 aa, Artificial Sequence
  Mouse C3 heavy chain variable framework region 3 (FWR3) acid sequence
KATMTVDKSSSTAYMELARLTSEDSAMYYCAR

SEQ ID NO: 425 - DNA, 30 bp, Artificial Sequence
  Mouse C3 heavy chain variable complementarity determining regions 3 (CDR3) sequence
tcggattactacggcccatactttgactac

SEQ ID NO: 426 - protein, 10 aa, Artificial Sequence
  Mouse C3 heavy chain variable complementarity determining regions 3 (CDR3) sequence
SDYYGPYFDY

SEQ ID NO: 427 - DNA, 296 bp, Artificial Sequence
  IGHV1-18*04 heavy chain variable region sequence
caggttcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaga

SEQ ID NO: 428 - protein, 98 aa, Artificial Sequence
  IGHV1-18*04 heavy chain variable region sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAR

SEQ ID NO: 429 - DNA, 90 bp, Artificial Sequence
  IGHV1-18*04 heavy chain variable framework region 1 (FWR1) sequence
caggttcagctggtgcagtctggagctgaggtgaagaagcctggggcctcagtgaaggtctcctgcaaggcttctggttacacctttacc

SEQ ID NO: 430 - protein, 30 aa, Artificial Sequence
  IGHV1-18*04 heavy chain variable framework region 1 (FWR1) sequence
QVQLVQSGAEVKKPGASVKVSCKASGYTFT

SEQ ID NO: 431 - DNA, 15 bp, Artificial Sequence
  IGHV1-18*04 heavy chain variable complementarity determining regions 1 (CDR1) sequence
agctacggtatcagc

SEQ ID NO: 432 - protein, 5 aa, Artificial Sequence
  IGHV1-18*04 heavy chain variable complementarity determining regions 1 (CDR1) sequence
SYGIS

SEQ ID NO: 433 - DNA, 42 bp, Artificial Sequence
  IGHV1-18*04 heavy chain variable framework region 2 (FWR2) sequence
tgggtgcgacaggcccctggacaagggcttgagtggatggga

SEQ ID NO: 434 - protein, 14 aa, Artificial Sequence
  IGHV1-18*04 heavy chain variable framework region 2 (FWR2) sequence
WVRQAPGQGLEWMG

SEQ ID NO: 435 - DNA, 51 bp, Artificial Sequence
  IGHV1-18*04 heavy chain variable complementarity determining regions 2 (CDR2) sequence
tggatcagcgcttacaatggtaacacaaactatgcacagaagctccagggc

SEQ ID NO: 436 - protein, 17 aa, Artificial Sequence
  IGHV1-18*04 heavy chain variable complementarity determining regions 2 (CDR2) sequence
WISAYNGNTNYAQKLQG

SEQ ID NO: 437 - DNA, 96 bp, Artificial Sequence
  IGHV1-18*04 heavy chain variable framework region 3 (FWR3) sequence
agagtcaccatgaccacagacacatccacgagcacagcctacatggagctgaggagcctgagatctgacgacacggccgtgtattactgtgcgaga

SEQ ID NO: 438 - protein, 32 aa, Artificial Sequence
  IGHV1-18*04 heavy chain variable framework region 3 (FWR3) sequence
RVTMTTDTSTSTAYMELRSLRSDDTAVYYCAR

SEQ ID NO: 439 - DNA, 357 bp, Artificial Sequence
  Humanized C3 heavy chain variable region sequence
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagc

SEQ ID NO: 440 - protein, 119 aa, Artificial Sequence
  Humanized C3 heavy chain variable region sequence
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSS

SEQ ID NO: 441 - DNA, 90 bp, Artificial Sequence; identical to SEQ ID NO: 429
  Humanized C3 heavy chain variable framework region 1 (FWR1) acid sequence

SEQ ID NO: 442 - protein, 30 aa, Artificial Sequence; identical to SEQ ID NO: 430
  Humanized C3 heavy chain variable framework region 1 (FWR1) acid sequence

SEQ ID NO: 443 - DNA, 15 bp, Artificial Sequence
  Humanized C3 heavy chain variable complementarity determining regions 1 (CDR1) sequence
gactacgccatgaac

SEQ ID NO: 444 - protein, 5 aa, Artificial Sequence
  Humanized C3 heavy chain variable complementarity determining regions 1 (CDR1) sequence
DYAMN

SEQ ID NO: 445 - DNA, 42 bp, Artificial Sequence; identical to SEQ ID NO: 433
  Humanized C3 heavy chain variable framework region 2 (FWR2) acid sequence

SEQ ID NO: 446 - protein, 14 aa, Artificial Sequence
  Humanized C3 heavy chain variable framework region 2 (FWR2) acid sequence
WVRQAPGQGLEWMG

SEQ ID NO: 447 - DNA, 51 bp, Artificial Sequence
  Humanized C3 heavy chain variable complementarity determining regions 2 (CDR2) sequence
gtgatcagcaccttcagcggtaacacaaacttcaaccagaagttcaagggc

SEQ ID NO: 448 - protein, 17 aa, Artificial Sequence
  Humanized C3 heavy chain variable complementarity determining regions 2 (CDR2) sequence
VISTFSGNTNFNQKFKG

SEQ ID NO: 449 - DNA, 96 bp, Artificial Sequence; identical to SEQ ID NO: 437
  Humanized C3 heavy chain variable framework region 3 (FWR3) acid sequence

SEQ ID NO: 450 - protein, 32 aa, Artificial Sequence; identical to SEQ ID NO: 438
  Humanized C3 heavy chain variable framework region 3 (FWR3) acid sequence

SEQ ID NO: 451 - DNA, 30 bp, Artificial Sequence
  Humanized C3 heavy chain variable complementarity determining regions 3 (CDR3) sequence
agcgactactacggcccatacttcgactac

SEQ ID NO: 452 - protein, 10 aa, Artificial Sequence
  Humanized C3 heavy chain variable complementarity determining regions 3 (CDR3) sequence
SDYYGPYFDY

SEQ ID NO: 453 - DNA, 1353 bp, Artificial Sequence
  Humanized C3 IgG1 heavy chain sequence
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 454 - protein, 449 aa, Artificial Sequence
  Humanized C3 IgG1 heavy chain sequence
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - DNA, 1341 bp, Artificial Sequence
  Humanized C3 IgG2 heavy chain sequence
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaa

SEQ ID NO: 456 - protein, 445 aa, Artificial Sequence
  Humanized C3 IgG2 heavy chain sequence
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 457 - DNA, 545 bp, Artificial Sequence
  Humanized C3 heavy chain IgG1 gBLOCK sequence
tgctctgggttccaggttccactggtgacgcggcccagccggcccaggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagc

SEQ ID NO: 458 - DNA, 336 bp, Artificial Sequence
  Mouse C3 Light Chain variable region sequence
gatgttttgatgacccaaactccactctccctgcctgtcagtcttggagatcaagcctccatctcttgcagatctagtcagaccattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcaacagagtggaggctgaggatctgggagtttattactgctttcaaggttcacatgttccattcacgttcggctcggggacaaagttggaaataaaa

SEQ ID NO: 459 - protein, 112 aa, Artificial Sequence
  Mouse C3 Light Chain variable region sequence
DVLMTQTPLSLPVSLGDQASISCRSSQTIVHSNGNTYLEWYLQKPGQSPKLLIYKVSNRFSGVPDRFSGSGSGTDFTLKINRVEAEDLGVYYCFQGSHVPFTFGSGTKLEIK

SEQ ID NO: 460 - DNA, 69 bp, Artificial Sequence
  Mouse C3 light chain variable framework region 1 (FWR1) sequence
gatgttttgatgacccaaactccactctccctgcctgtcagtcttggagatcaagcctccatctcttgc

SEQ ID NO: 461 - protein, 23 aa, Artificial Sequence
  Mouse C3 light chain variable framework region 1 (FWR1) sequence
DVLMTQTPLSLPVSLGDQASISC

SEQ ID NO: 462 - DNA, 48 bp, Artificial Sequence
  Mouse C3 light chain variable complementarity determining regions 1 (CDR1) sequence
agatctagtcagaccattgtacatagtaatggaaacacctatttagaa

SEQ ID NO: 463 - protein, 16 aa, Artificial Sequence
  Mouse C3 light chain variable complementarity determining regions 1 (CDR1) sequence
RSSQTIVHSNGNTYLE

SEQ ID NO: 464 - DNA, 45 bp, Artificial Sequence
  Mouse C3 light chain variable framework region 2 (FWR2) sequence
tggtacctgcagaaaccaggccagtctccaaagctcctgatctac

SEQ ID NO: 465 - protein, 15 aa, Artificial Sequence
  Mouse C3 light chain variable framework region 2 (FWR2) sequence
WYLQKPGQSPKLLIY

SEQ ID NO: 466 - DNA, 21 bp, Artificial Sequence
  Mouse C3 light chain variable complementarity determining regions 2 (CDR2) sequence
aaagtttccaaccgattttct

SEQ ID NO: 467 - protein, 7 aa, Artificial Sequence
  Mouse C3 light chain variable complementarity determining regions 2 (CDR2) sequence
KVSNRFS

SEQ ID NO: 468 - DNA, 96 bp, Artificial Sequence
  Mouse C3 light chain variable framework region 3 (FWR3) sequence
ggggtcccagacaggttcagtggcagtggatcagggacagatttcacactcaagatcaacagagtggaggctgaggatctgggagtttattactgc

SEQ ID NO: 469 - protein, 32 aa, Artificial Sequence
  Mouse C3 light chain variable framework region 3 (FWR3) sequence
GVPDRFSGSGSGTDFTLKINRVEAEDLGVYYC

SEQ ID NO: 470 - DNA, 27 bp, Artificial Sequence
  Mouse C3 light chain variable complementarity determining regions 3 (CDR3) sequence
tttcaaggttcacatgttccattcacg

SEQ ID NO: 471 - protein, 9 aa, Artificial Sequence
  Mouse C3 light chain variable complementarity determining regions 3 (CDR3) sequence
FQGSHVPFT

SEQ ID NO: 472 - DNA, 300 bp, Artificial Sequence
  IGKV2-29*03 light chain variable region sequence
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccagccggttctctggagtgccagataggttcagtggcagcgggtcagggacagatttcacactgaaaatcagccgggtggaggctgaggatgttggggtttattactgcatgcaaggtatacaccttcct

SEQ ID NO: 473 - protein, 100 aa, Artificial Sequence
  IGKV2-29*03 light chain variable region sequence
DIVMTQTPLSLSVTPGQPASISCKSSQSLLHSDGKTYLYWYLQKPGQSPQLLIYEVSSRFSGVPDRFSGSGSGTDFTLKISRVEAEDVGVYYCMQGIHLP

SEQ ID NO: 474 - DNA, 69 bp, Artificial Sequence
  IGKV2-29*03 light chain variable framework region 1 (FWR1) acid sequence
gatattgtgatgacccagactccactctctctgtccgtcacccctggacagccggcctccatctcctgc

SEQ ID NO: 475 - protein, 23 aa, Artificial Sequence
  IGKV2-29*03 light chain variable framework region 1 (FWR1) acid sequence
DIVMTQTPLSLSVTPGQPASISC

SEQ ID NO: 476 - DNA, 49 bp, Artificial Sequence
  IGKV2-29*03 light chain variable complementarity determining regions 1 (CDR1) sequence
aagtctagtcagagcctcctgcatagtgatggaaagacctatttsgtat

SEQ ID NO: 477 - protein, 16 aa, Artificial Sequence
  IGKV2-29*03 light chain variable complementarity determining regions 1 (CDR1) sequence
KSSQSLLHSDGKTYLY

SEQ ID NO: 478 - DNA, 45 bp, Artificial Sequence
  IGKV2-29*03 light chain variable framework region 2 (FWR2) sequence
tggtacctgcagaagccaggccagtctccacagctcctgatctat

SEQ ID NO: 479 - protein, 15 aa, Artificial Sequence
  IGKV2-29*03 light chain variable framework region 2 (FWR2) sequence
WYLQKPGQSPQLLIY

SEQ ID NO: 480 - DNA, 18 bp, Artificial Sequence
  IGKV2-29*03 light chain variable complementarity determining regions 2 (CDR2) sequence
gaagtttccagccggttc

SEQ ID NO: 481 - protein, 7 aa, Artificial Sequence
  IGKV2-29*03 light chain variable complementarity determining regions 2 (CDR2) sequence
EVSSRFS

SEQ ID NO: 482 - DNA, 96 bp, Artificial Sequence
  IGKV2-29*03 light chain variable framework region 3 (FWR3) sequence
ggagtgccagataggttcagtggcagcgggtcagggacagatttcacactgaaaatcagccgggtggaggctgaggatgttggggtttattactgc

SEQ ID NO: 483 - protein, 32 aa, Artificial Sequence
  IGKV2-29*03 light chain variable framework region 3 (FWR3) sequence
GVPDRFSGSGSGTDFTLKISRVEAEDVGVYYC

SEQ ID NO: 484 - DNA, 21 bp, Artificial Sequence
  IGKV2-29*03 light chain variable complementarity determining regions3 (CDR3) sequence
atgcaaggtatacaccttcct

SEQ ID NO: 485 - protein, 7 aa, Artificial Sequence
  IGKV2-29*03 light chain variable complementarity determining regions3 (CDR3) sequence
MQGIHLP

SEQ ID NO: 486 - DNA, 342 bp, Artificial Sequence
  Humanized C3 light chain variable region sequence
gatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaact

SEQ ID NO: 487 - protein, 114 aa, Artificial Sequence
  Humanized C3 light chain variable region sequence
DIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRT

SEQ ID NO: 488 - DNA, 69 bp, Artificial Sequence; identical to SEQ ID NO: 474
  Humanized C3 light chain variable framework region 1 (FWR1) acid sequence

SEQ ID NO: 489 - protein, 23 aa, Artificial Sequence
  Humanized C3 light chain variable framework region 1 (FWR1) acid sequence
DIVMTQTPLSLSVTPGQPASISC

SEQ ID NO: 490 - DNA, 47 bp, Artificial Sequence
  Humanized C3 light chain variable complementarity determining regions 1 (CDR1) sequence
ggtctagtcagaccattgtccatagtaatggaaacacctatttggag

SEQ ID NO: 491 - protein, 16 aa, Artificial Sequence
  Humanized C3 light chain variable complementarity determining regions 1 (CDR1) sequence
RSSQTIVHSNGNTYLE

SEQ ID NO: 492 - DNA, 45 bp, Artificial Sequence; identical to SEQ ID NO: 478
  Humanized C3 light chain variable framework region 2 (FWR2) acid sequence

SEQ ID NO: 493 - protein, 15 aa, Artificial Sequence
  Humanized C3 light chain variable framework region 2 (FWR2) acid sequence
WYLQKPGQSPQLLIY

SEQ ID NO: 494 - DNA, 21 bp, Artificial Sequence
  Humanized C3 light chain variable complementarity determining regions 2 (CDR2) sequence
aaggtttccaaccggttctct

SEQ ID NO: 495 - protein, 7 aa, Artificial Sequence
  Humanized C3 light chain variable complementarity determining regions 2 (CDR2) sequence
KVSNRFS

SEQ ID NO: 496 - DNA, 96 bp, Artificial Sequence; identical to SEQ ID NO: 482
  Humanized C3 light chain variable framework region 3 (FWR3) acid sequence

SEQ ID NO: 497 - protein, 32 aa, Artificial Sequence; identical to SEQ ID NO: 483
  Humanized C3 light chain variable framework region 3 (FWR3) acid sequence

SEQ ID NO: 498 - DNA, 27 bp, Artificial Sequence
  Humanized C3 light chain variable complementarity determining regions 3 (CDR3) sequence
ttccaaggtagccacgtgcctttcacc

SEQ ID NO: 499 - protein, 9 aa, Artificial Sequence
  Humanized C3 light chain variable complementarity determining regions 3 (CDR3) sequence
FQGSHVPFT

SEQ ID NO: 500 - DNA, 666 bp, Artificial Sequence
  Humanized C3 lambda light chain  sequence
gatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 501 - protein, 220 aa, Artificial Sequence
  Humanized C3 lambda light chain  sequence
DIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRTGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 502 - DNA, 666 bp, Artificial Sequence
  Humanized C3 Kappa light chain
gatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaa

SEQ ID NO: 503 - protein, 220 aa, Artificial Sequence
  Humanized C3 Kappa light chain
DIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRTTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - DNA, 815 bp, Artificial Sequence
  Humanized C3 Kappa light gBLOCK sequence
agctggctaggtaagcttggtaccgagctcggatccacgccaccatggagacagacacactcctgctatgggtactgctgctctgggttccaggttccactggtgacgatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaagtttaaacccgctgatcagcctcgactgtgccttctagttgc

SEQ ID NO: 505 - DNA, 321 bp, Artificial Sequence
  Mouse C8 heavy chain variable region sequence
gaagtgatggtcgtggaaagcggcggtggtctggtaaagccggggggatcccttaagctttcttgcgccgcatccgggttcacgttctccggctatgccatgtcctgggtccgacagactcccgaaaagcgcttggaatgggtggccactatctcctccggggggacgtacatctactaccccgacagtgtgaaaggaagatttacaatatctcgcgacaacgcaaaaaataccttgtatcttcaaatgagctccctgcggtcagaggacactgccatgtactattgcgcccgcctgggcggcgacaattactatgagtat

SEQ ID NO: 506 - protein, 107 aa, Artificial Sequence
  Mouse C8 heavy chain variable region sequence
EVMVVESGGGLVKPGGSLKLSCAASGFTFSGYAMSWVRQTPEKRLEWVATISSGGTYIYYPDSVKGRFTISRDNAKNTLYLQMSSLRSEDTAMYYCARLGGDNYYEY

SEQ ID NO: 507 - DNA, 15 bp, Artificial Sequence
  Mouse C8 heavy chain variable complementarity determining region 1 (CDR1) sequence
ggctatgccatgtcc

SEQ ID NO: 508 - protein, 5 aa, Artificial Sequence
  Mouse C8 heavy chain variable complementarity determining region 1 (CDR1) sequence
GYAMS

SEQ ID NO: 509 - DNA, 51 bp, Artificial Sequence
  Mouse C8 heavy chain variable complementarity determining region 2 (CDR2) sequence
actatctcctccggggggacgtacatctactaccccgacagtgtgaaagga

SEQ ID NO: 510 - protein, 17 aa, Artificial Sequence
  Mouse C8 heavy chain variable complementarity determining region 2 (CDR2) sequence
TISSGGTYIYYPDSVKG

SEQ ID NO: 511 - DNA, 27 bp, Artificial Sequence
  Mouse C8 heavy chain variable complementarity determining region 3 (CDR3) sequence
ctgggcggcgacaattactatgagtat

SEQ ID NO: 512 - protein, 9 aa, Artificial Sequence
  Mouse C8 heavy chain variable complementarity determining region 3 (CDR3) sequence
LGGDNYYEY

SEQ ID NO: 513 - DNA, 292 bp, Artificial Sequence
  IGHV3-21*04 heavy chain variable region sequence
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggccgtgtattactgtgcga

SEQ ID NO: 514 - protein, 98 aa, Artificial Sequence; identical to SEQ ID NO: 27
  IGHV3-21*04 heavy chain variable region sequence

SEQ ID NO: 515 - DNA, 90 bp, Artificial Sequence; identical to SEQ ID NO: 28
  IGHV3-21*04 heavy chain variable framework region 1 (FWR1) sequence

SEQ ID NO: 516 - protein, 30 aa, Artificial Sequence; identical to SEQ ID NO: 29
  IGHV3-21*04 heavy chain variable framework region 1 (FWR1) sequence

SEQ ID NO: 517 - DNA, 15 bp, Artificial Sequence
  IGHV3-21*04 heavy chain variable complementarity determining regions 1 (CDR1) sequence
agctatagcatgaac

SEQ ID NO: 518 - protein, 5 aa, Artificial Sequence
  IGHV3-21*04 heavy chain variable complementarity determining regions 1 (CDR1) sequence
SYSMN

SEQ ID NO: 519 - DNA, 39 bp, Artificial Sequence
  IGHV3-21*04 heavy chain variable framework region 2 (FWR2) sequence
tgggtccgccaggctccagggaaggggctggagtgggtc

SEQ ID NO: 520 - protein, 13 aa, Artificial Sequence
  IGHV3-21*04 heavy chain variable framework region 2 (FWR2) sequence
WVRQAPGKGLEWV

SEQ ID NO: 521 - DNA, 54 bp, Artificial Sequence
  IGHV3-21*04 heavy chain variable complementarity determining regions 2 (CDR2) sequence
tcatccattagtagtagtagtagttacatatactacgcagactcagtgaagggc

SEQ ID NO: 522 - protein, 18 aa, Artificial Sequence
  IGHV3-21*04 heavy chain variable complementarity determining regions 2 (CDR2) sequence
SSISSSSSYIYYADSVKG

SEQ ID NO: 523 - DNA, 94 bp, Artificial Sequence
  IGHV3-21*04 heavy chain variable framework region 3 (FWR3) sequence
cgattcaccatctccagagacaacgccaagaactcactgtatctgcaaatgaacagcctgagagccgaggacacggccgtgtattactgtgcga

SEQ ID NO: 524 - protein, 32 aa, Artificial Sequence; identical to SEQ ID NO: 37
  IGHV3-21*04 heavy chain variable framework region 3 (FWR3) sequence

SEQ ID NO: 525 - DNA, 354 bp, Artificial Sequence
  Humanized C8 heavy chain variable region sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctcc

SEQ ID NO: 526 - protein, 118 aa, Artificial Sequence
  Humanized C8 heavy chain variable region sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSS

SEQ ID NO: 527 - DNA, 90 bp, Artificial Sequence; identical to SEQ ID NO: 28
  Humanized C8 heavy chain variable framework region 1 (FWR1) sequence

SEQ ID NO: 528 - protein, 30 aa, Artificial Sequence; identical to SEQ ID NO: 29
  Humanized C8 heavy chain variable framework region 1 (FWR1) sequence

SEQ ID NO: 529 - DNA, 15 bp, Artificial Sequence
  Humanized C8 heavy chain variable complementarity determining region 1 (CDR1) sequence
ggctatgccatgagc

SEQ ID NO: 530 - protein, 5 aa, Artificial Sequence
  Humanized C8 heavy chain variable complementarity determining region 1 (CDR1) sequence
GYAMS

SEQ ID NO: 531 - DNA, 42 bp, Artificial Sequence; identical to SEQ ID NO: 32
  Humanized C8 heavy chain variable framework region 2 (FWR2) sequence

SEQ ID NO: 532 - protein, 14 aa, Artificial Sequence
  Humanized C8 heavy chain variable framework region 2 (FWR2) sequence
WVRQAPGKGLEWVS

SEQ ID NO: 533 - DNA, 51 bp, Artificial Sequence
  Humanized C8 heavy chain variable complementarity determining region 2 (CDR2) sequence
accattagtagtggcggaacctacatatactaccctgactcagtgaagggc

SEQ ID NO: 534 - protein, 17 aa, Artificial Sequence
  Humanized C8 heavy chain variable complementarity determining region 2 (CDR2) sequence
TISSGGTYIYYPDSVKG

SEQ ID NO: 535 - DNA, 96 bp, Artificial Sequence; identical to SEQ ID NO: 142
  Humanized C8 heavy chain variable framework region 3 (FWR3) sequence

SEQ ID NO: 536 - protein, 32 aa, Artificial Sequence; identical to SEQ ID NO: 37
  Humanized C8 heavy chain variable framework region 3 (FWR3) sequence

SEQ ID NO: 537 - DNA, 27 bp, Artificial Sequence
  Humanized C8 heavy chain variable complementarity determining region 3 (CDR3) sequence
ctgggcggcgataactattatgaatat

SEQ ID NO: 538 - protein, 9 aa, Artificial Sequence
  Humanized C8 heavy chain variable complementarity determining region 3 (CDR3) sequence
LGGDNYYEY

SEQ ID NO: 539 - DNA, 1350 bp, Artificial Sequence
  Humanized C8 IgG1 heavy chain sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 540 - protein, 448 aa, Artificial Sequence
  Humanized C8 IgG1 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 541 - DNA, 1338 bp, Artificial Sequence
  Humanized C8 IgG2 heavy chain sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaa

SEQ ID NO: 542 - protein, 444 aa, Artificial Sequence
  Humanized C8 IgG2 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 543 - DNA, 306 bp, Artificial Sequence
  Mouse C8 light chain variable region sequence
gacatcgtcattacgcagacccctgccagtcttgccgtttctctgggccagagggccactatcagttacagggcgagtaagtctgtgagtaccagcggctatagttacatgcattggaaccagcagaaaccgggacagccaccacgcctgcttatttatctggtgtctaatcttgagtccggggtgcccgccaggttcagcggcagcggctctgggaccgacttcacactcaacattcatccagtggaagaagaggacgctgctacatactactgtcaacacattcgggaactgaccaggagtgaa

SEQ ID NO: 544 - protein, 102 aa, Artificial Sequence
  Mouse C8 light chain variable region sequence
DIVITQTPASLAVSLGQRATISYRASKSVSTSGYSYMHWNQQKPGQPPRLLIYLVSNLESGVPARFSGSGSGTDFTLNIHPVEEEDAATYYCQHIRELTRSE

SEQ ID NO: 545 - DNA, 45 bp, Artificial Sequence
  Mouse C8 light chain variable complementarity determining region 1 (CDR1) sequence
agggcgagtaagtctgtgagtaccagcggctatagttacatgcat

SEQ ID NO: 546 - protein, 15 aa, Artificial Sequence
  Mouse C8 light chain variable complementarity determining region 1 (CDR1) sequence
RASKSVSTSGYSYMH

SEQ ID NO: 547 - DNA, 21 bp, Artificial Sequence
  Mouse C8 light chain variable complementarity determining region 2 (CDR2) sequence
ctggtgtctaatcttgagtcc

SEQ ID NO: 548 - protein, 7 aa, Artificial Sequence
  Mouse C8 light chain variable complementarity determining region 2 (CDR2) sequence
LVSNLES

SEQ ID NO: 549 - DNA, 30 bp, Artificial Sequence
  Mouse C8 light chain variable complementarity determining region 3 (CDR3) sequence
caacacattcgggaactgaccaggagtgaa

SEQ ID NO: 550 - protein, 10 aa, Artificial Sequence
  Mouse C8 light chain variable complementarity determining region 3 (CDR3) sequence
QHIRELTRSE

SEQ ID NO: 551 - DNA, 303 bp, Artificial Sequence
  NCBI germline z00023 light chain variable region sequence
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcct

SEQ ID NO: 552 - protein, 101 aa, Artificial Sequence
  NCBI germline z00023 light chain variable region sequence
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTP

SEQ ID NO: 553 - DNA, 69 bp, Artificial Sequence
  NCBI germline z00023 light chain variable framework region 1 (FWR1) acid sequence
gacatcgtgatgacccagtctccagactccctggctgtgtctctgggcgagagggccaccatcaactgc

SEQ ID NO: 554 - protein, 23 aa, Artificial Sequence
  NCBI germline z00023 light chain variable framework region 1 (FWR1) acid sequence
DIVMTQSPDSLAVSLGERATINC

SEQ ID NO: 555 - DNA, 51 bp, Artificial Sequence
  NCBI germline z00023 light chain variable complementarity determining regions 1 (CDR1) sequence
aagtccagccagagtgttttatacagctccaacaataagaactacttagct

SEQ ID NO: 556 - protein, 17 aa, Artificial Sequence
  NCBI germline z00023 light chain variable complementarity determining regions 1 (CDR1) sequence
KSSQSVLYSSNNKNYLA

SEQ ID NO: 557 - DNA, 45 bp, Artificial Sequence
  NCBI germline z00023 light chain variable framework region 2 (FWR2) sequence
tggtaccagcagaaaccaggacagcctcctaagctgctcatttac

SEQ ID NO: 558 - protein, 15 aa, Artificial Sequence
  NCBI germline z00023 light chain variable framework region 2 (FWR2) sequence
WYQQKPGQPPKLLIY

SEQ ID NO: 559 - DNA, 21 bp, Artificial Sequence
  NCBI germline z00023 light chain variable complementarity determining regions 2 (CDR2) sequence
tgggcatctacccgggaatcc

SEQ ID NO: 560 - protein, 7 aa, Artificial Sequence
  NCBI germline z00023 light chain variable complementarity determining regions 2 (CDR2) sequence
WASTRES

SEQ ID NO: 561 - DNA, 96 bp, Artificial Sequence
  NCBI germline z00023 light chain variable framework region 3 (FWR3) sequence
ggggtccctgaccgattcagtggcagcgggtctgggacagatttcactctcaccatcagcagcctgcaggctgaagatgtggcagtttattactgt

SEQ ID NO: 562 - protein, 32 aa, Artificial Sequence
  NCBI germline z00023 light chain variable framework region 3 (FWR3) sequence
GVPDRFSGSGSGTDFTLTISSLQAEDVAVYYC

SEQ ID NO: 563 - DNA, 21 bp, Artificial Sequence
  NCBI germline z00023 light chain variable complementarity determining regions3 (CDR3) sequence
cagcaatattatagtactcct

SEQ ID NO: 564 - protein, 7 aa, Artificial Sequence
  NCBI germline z00023 light chain variable complementarity determining regions3 (CDR3) sequence
QQYYSTP

SEQ ID NO: 565 - DNA, 342 bp, Artificial Sequence
  Humanized C8 light chain variable region sequence
gacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaact

SEQ ID NO: 566 - protein, 114 aa, Artificial Sequence
  Humanized C8 light chain variable region sequence
DIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRT

SEQ ID NO: 567 - DNA, 69 bp, Artificial Sequence; identical to SEQ ID NO: 553
  Humanized C8 light chain variable framework region 1 (FWR1) sequence

SEQ ID NO: 568 - protein, 23 aa, Artificial Sequence
  Humanized C8 light chain variable framework region 1 (FWR1) sequence
DIVMTQSPDSLAVSLGERATINC

SEQ ID NO: 569 - DNA, 42 bp, Artificial Sequence
  Humanized C8 light chain variable complementarity determining region 1 (CDR1) sequence
agggccagcaagagtgttagcaccagcggctacagctacatg

SEQ ID NO: 570 - protein, 14 aa, Artificial Sequence
  Humanized C8 light chain variable complementarity determining region 1 (CDR1) sequence
RASKSVSTSGYSYM

SEQ ID NO: 571 - DNA, 48 bp, Artificial Sequence
  Humanized C8 light chain variable framework region 2 (FWR2) sequence
cactggtaccagcagaaaccaggacagcctcctaagctgctcatttac

SEQ ID NO: 572 - protein, 16 aa, Artificial Sequence
  Humanized C8 light chain variable framework region 2 (FWR2) sequence
HWYQQKPGQPPKLLIY

SEQ ID NO: 573 - DNA, 21 bp, Artificial Sequence
  Humanized C8 light chain variable complementarity determining region 2 (CDR2) sequence
ctggtgtctaacctggaatcc

SEQ ID NO: 574 - protein, 7 aa, Artificial Sequence
  Humanized C8 light chain variable complementarity determining region 2 (CDR2) sequence
LVSNLES

SEQ ID NO: 575 - DNA, 96 bp, Artificial Sequence; identical to SEQ ID NO: 561
  Humanized C8 light chain variable framework region 3 (FWR3) sequence

SEQ ID NO: 576 - protein, 32 aa, Artificial Sequence; identical to SEQ ID NO: 562
  Humanized C8 light chain variable framework region 3 (FWR3) sequence

SEQ ID NO: 577 - DNA, 30 bp, Artificial Sequence; identical to SEQ ID NO: 549
  Humanized C8 light chain variable complementarity determining region 3 (CDR3) sequence

SEQ ID NO: 578 - protein, 10 aa, Artificial Sequence
  Humanized C8 light chain variable complementarity determining region 3 (CDR3) sequence
QHIRELTRSE

SEQ ID NO: 579 - DNA, 666 bp, Artificial Sequence
  Humanized C8 Lambda light chain sequence
gacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaactggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 580 - protein, 220 aa, Artificial Sequence
  Humanized C8 Lambda light chain sequence
DIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRTGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 581 - DNA, 666 bp, Artificial Sequence
  Humanized C8 Kappa light chain sequence
gacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaa

SEQ ID NO: 582 - protein, 220 aa, Artificial Sequence
  Humanized C8 Kappa light chain sequence
DIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRTTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 583 - DNA, 815 bp, Artificial Sequence
  Humanized C8 Kappa light chain gBLOCk sequence
agctggctaggtaagcttggtaccgagctcggatccacgccaccatggagacagacacactcctgctatgggtactgctgctctgggttccaggttccactggtgacgacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaagtttaaacccgctgatcagcctcgactgtgccttctagttgc

SEQ ID NO: 584 - DNA, 942 bp, Artificial Sequence
  CAR-T E6 CD8 sequence
gaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgctgataa

SEQ ID NO: 585 - protein, 312 aa, Artificial Sequence
  CAR-T E6 CD8 sequence
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYC

SEQ ID NO: 586 - DNA, 960 bp, Artificial Sequence
  CAR-T C2 CD8 sequence
gaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgctgataa

SEQ ID NO: 587 - protein, 318 aa, Artificial Sequence
  CAR-T C2 CD8 sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYC

SEQ ID NO: 588 - DNA, 339 bp, Artificial Sequence
  CD8/4-1BB sequence
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgtgataa

SEQ ID NO: 589 - protein, 111 aa, Artificial Sequence
  CD8/4-1BB sequence
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 590 - DNA, 336 bp, Artificial Sequence
  CD8/CD28 sequence
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcctgataa

SEQ ID NO: 591 - protein, 110 aa, Artificial Sequence
  CD8/CD28 sequence
TTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRS

SEQ ID NO: 592 - DNA, 549 bp, Artificial Sequence
  CD8/CD3z sequence
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 593 - protein, 181 aa, Artificial Sequence
  CD8/CD3z sequence
TTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 594 - DNA, 672 bp, Artificial Sequence
  CD8/CD28/CD3z sequence
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 595 - protein, 222 aa, Artificial Sequence
  CD8/CD28/CD3z sequence
TTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 596 - DNA, 675 bp, Artificial Sequence
  CD8/4-1BB/CD3z sequence
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 597 - protein, 223 aa, Artificial Sequence
  CD8/4-1BB/CD3z sequence
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 598 - DNA, 798 bp, Artificial Sequence
  CD8/CD28/4-1BB/CD3z sequence
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtccaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 599 - protein, 264 aa, Artificial Sequence
  CD8/CD28/4-1BB/CD3z sequence
TTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 600 - DNA, 1482 bp, Artificial Sequence
  CAR-T C3 4-1BB/CD3z sequence
atggccctgcccgtgaccgctttgctgctccccctggcgctgctgctgcacgccgccaggccacaggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcggcggtggcggatccggcggtggcggatccggcggtggcggatccgatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 601 - protein, 471 aa, Artificial Sequence
  CAR-T C3 4-1BB/CD3z sequence
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSGGGGSGGGGSGGGGSDIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 602 - DNA, 567 bp, Artificial Sequence
  C3 CAR gBLOCK 1 sequence
atccacgctgttttgacctccatagaagattctagagctagctgtagagcttggtaccgagggccaccatggccctgcccgtgaccgctttgctgctccccctggcgctgctgctgcacgccgccaggccacaggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcggcggtggcggatccggcggtggcggatccggcggtggcggatccgatattgtgatgacccagactccactctctctgt

SEQ ID NO: 603 - DNA, 509 bp, Artificial Sequence
  C3 CAR gBLOCK 2 sequence
tattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtg

SEQ ID NO: 604 - DNA, 455 bp, Artificial Sequence
  E6 scFV gBLOCK 1 sequence
tgctctgggttccaggttccactggtgacgcggcccagccggccgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatcc

SEQ ID NO: 605 - DNA, 432 bp, Artificial Sequence
  E6 scFV gBLOCK 2 sequence
ggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaaccggtcatcatcaccatcaccactgataagtttaaacccgctgatcagcctcgactgtgccttctagt

SEQ ID NO: 606 - DNA, 1359 bp, Artificial Sequence
  CAR-T C2 CD3z sequence
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 607 - protein, 451 aa, Artificial Sequence
  CAR-T C2 CD3z sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 608 - DNA, 1482 bp, Artificial Sequence
  CAR-T C2 CD28/CD3z sequence
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 609 - protein, 492 aa, Artificial Sequence
  CAR-T C2 CD28/CD3z sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 610 - DNA, 1485 bp, Artificial Sequence
  CAR-T C2 4-1BB/CD3z sequence
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 611 - protein, 493 aa, Artificial Sequence
  CAR-T C2 4-1BB/CD3z sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 612 - DNA, 1470 bp, Artificial Sequence
  CAR-T C2 OX40/CD3z sequence
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgccggagggaccagaggctgccccccgatgcccacaagccccctgggggaggcagtttccggacccccatccaagaggagcaggccgacgcccactccaccctggccaagatccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 613 - protein, 488 aa, Artificial Sequence
  CAR-T C2 OX40/CD3z sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 614 - DNA, 1593 bp, Artificial Sequence
  CAR-T C2 CD28/OX40/CD3z sequence
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccggagggaccagaggctgccccccgatgcccacaagccccctgggggaggcagtttccggacccccatccaagaggagcaggccgacgcccactccaccctggccaagatccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 615 - protein, 529 aa, Artificial Sequence
  CAR-T C2 CD28/OX40/CD3z sequence
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 616 - DNA, 1452 bp, Artificial Sequence
  CAR-T E6 OX40/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgccggagggaccagaggctgccccccgatgcccacaagccccctgggggaggcagtttccggacccccatccaagaggagcaggccgacgcccactccaccctggccaagatccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 617 - protein, 482 aa, Artificial Sequence
  CAR-T E6 OX40/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 618 - DNA, 1575 bp, Artificial Sequence
  CAR-T E6 CD28/OX40/CD3z sequence
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccggagggaccagaggctgccccccgatgcccacaagccccctgggggaggcagtttccggacccccatccaagaggagcaggccgacgcccactccaccctggccaagatccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 619 - protein, 523 aa, Artificial Sequence
  CAR-T E6 CD28/OX40/CD3z sequence
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRRDQRLPPDAHKPPGGGSFRTPIQEEQADAHSTLAKIRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 620 - protein, 43 aa, Artificial Sequence
  MUC1 FRAGMENT
SNIKFRPGSVVVQLTLAFREGTINVHDVETQFNQYKTEAASRY

SEQ ID NO: 621 - protein, 35 aa, Artificial Sequence
  MUC1 FRAGMENT
SVVVQLTLAFREGTINVHDVETQFNQYKTEAASRY

SEQ ID NO: 622 - protein, 24 aa, Artificial Sequence
  Cytoplasmic MUC1 truncated segment
VQLTLAFREGTINVHDVETQFNQY

SEQ ID NO: 623 - protein, 24 aa, Artificial Sequence
  Cytoplasmic MUC1 truncated segment
SNIKFRPGSVVVQLTLAFREGTIN

SEQ ID NO: 624 - DNA, 28 bp, Artificial Sequence
  Primer
attctaagcttgggccaccatggaactg

SEQ ID NO: 625 - DNA, 41 bp, Artificial Sequence
  Primer
tctagagtttaaacttactatttacccggagacagggagag

SEQ ID NO: 626 - DNA, 41 bp, Artificial Sequence
  Primer
agtatggcccagccggccgaggtgcagctggtggagtctgg

SEQ ID NO: 627 - DNA, 26 bp, Artificial Sequence
  Primer
tagaaggcacagtcgaggctgatcag

SEQ ID NO: 628 - DNA, 27 bp, Artificial Sequence
  Primer
attctaagcttgggccaccatggaagc

SEQ ID NO: 629 - DNA, 40 bp, Artificial Sequence
  Primer
tctagagtttaaacttactaacactctcccctgttgaagc

SEQ ID NO: 630 - DNA, 43 bp, Artificial Sequence
  Primer
agtatggcccagccggccgaaattgtgttgacacagtctccag

SEQ ID NO: 631 - DNA, 26 bp, Artificial Sequence
  Primer
tagaaggcacagtcgaggctgatcag

SEQ ID NO: 632 - DNA, 33 bp, Artificial Sequence
  Primer
actgtcatatggaggtgcagctggtggagtctg

SEQ ID NO: 633 - DNA, 37 bp, Artificial Sequence
  Primer
actgtctcgagtttaatttccactttggtgccgctgc

SEQ ID NO: 634 - DNA, 33 bp, Artificial Sequence; identical to SEQ ID NO: 632
  Primer

SEQ ID NO: 635 - DNA, 37 bp, Artificial Sequence
  Primer
actgtaccggttttaatttccactttggtgccgctgc

SEQ ID NO: 636 - DNA, 29 bp, Artificial Sequence
  Primer
cttcttcctcaggagcaagctcaccgtgg

SEQ ID NO: 637 - DNA, 18 bp, Artificial Sequence
  Primer
gagccgtcggagtccagc

SEQ ID NO: 638 - DNA, 18 bp, Artificial Sequence
  Primer
gcacctgaactcctgggg

SEQ ID NO: 639 - DNA, 22 bp, Artificial Sequence
  Primer
tttaatttccactttggtgccg

SEQ ID NO: 640 - DNA, 32 bp, Artificial Sequence
  Primer
cgcggctagcttaagcttggtaccgagggcca

SEQ ID NO: 641 - DNA, 36 bp, Artificial Sequence
  Primer
cgcggcggccgcctgatcagcgggtttaaacttatc

SEQ ID NO: 642 - protein, 35 aa, Artificial Sequence
  PSMGFR N-10
QFNQYKTEAASRYNLTISDVSVSDVPFPFSAQSGA

SEQ ID NO: 643 - protein, 35 aa, Artificial Sequence
  PSMGFR C-10
GTINVHDVETQFNQYKTEAASRYNLTISDVSVSDV

The invention claimed is:

1. A chimeric antigen receptor (CAR) comprising a scFv or humanized scFv of an MN-E6 scFv set forth as consisting of SEQ ID NOS: 233, 235, or 237, MN-C2 scFv set forth as consisting of SEQ ID NOS:239, 241, or 243, MN-C3 scFv set forth as consisting of SEQ ID NOS: 245, 247, or 249 or MN-C8 scFv set forth as consisting of SEQ ID NOS:251, 253, or 255.

2. The CAR as in claim 1, further comprising a cytoplasmic tail comprising one or more of signaling sequence motifs selected from the group consisting of:

CD3-zeta, CD27, CD28, 4-1BB, 0X40, CD30, CD40, PD-1, ICAm-1, LFA-1, ICOS, CD2, CDS, and CD7.

3. The CAR as in claim 1, wherein its sequence is CARIVIN-E6 CD3z (SEQ ID NO:295), CARIVIN-E6 CD28/CD3z (SEQ ID NO :298); CARMN-E6 4-1BB/CD3z (SEQ ID NO :301); CARMN-E6 0X40/CD3z (SEQ ID NO :617); CARMN-E6 CD28/4-1BB/CD3z (SEQ ID NO :304); CARMN-E6 CD28/0X40/CD3z (SEQ ID N0:619); CAR MN-C2 CD3z (SEQ ID NO :607); CAR MN-C2 CD28/CD3z (SEQ ID N0:609); CAR MN-C2 4-1BB/CD3z (SEQ ID NO :611); CAR MN-C2 0X40/CD3z (SEQ ID NO :613); CAR MN-C2 CD28/4-1BB/CD3z (SEQ ID NO :307); or CAR MN-C2 CD28/0X40/CD3z (SEQ ID NO :615).

4. A cell comprising the CAR of claim 1.

5. The cell according to claim 4, wherein the cell comprising the CAR is an immune system cell.

6. The cell according to claim 5, wherein the immune system cell comprising the CAR is T cell.

7. The cell according to claim 5, wherein the immune system cell comprising the CAR is dendritic cell.

8. The cell according to claim 5, wherein the immune system cell comprising the CAR is mast cell.

9. The CAR as in claim 1, wherein the scFv or humanized scFv is of the MN-C2 scFv set forth as consisting of SEQ ID NOS:239, 241, or 243.

10. The CAR as in claim 1, wherein the scFv or humanized scFv is of the MN-E6 scFv set forth as consisting of SEQ ID NOS: 233, 235, or 237.

11. The CAR as in claim 1, wherein the scFv or humanized scFv is of the MN-C3 scFv set forth as consisting of SEQ ID NOS: 245, 247, or 249.

12. The CAR as in claim 1, wherein the scFv or humanized scFv is of the MN-C8 scFv set forth as consisting of SEQ ID NOS:251, 253, or 255.

13. The CAR of claim 3, wherein its sequence is CAR MN-C2 4-1BB/CD3z (SEQ ID NO :611).

* * * * *